(12) United States Patent
Herron-Olson et al.

(10) Patent No.: US 9,932,373 B2
(45) Date of Patent: Apr. 3, 2018

(54) POLYPEPTIDES AND IMMUNIZING COMPOSITIONS CONTAINING GRAM POSITIVE POLYPEPTIDES AND METHODS OF USE

(75) Inventors: Lisa L. Herron-Olson, Minneapolis, MN (US); Drew M. Catron, Shoreview, MN (US)

(73) Assignee: EPITOPIX, LLC, Willmar, MN (US)

( * ) Notice: Subject to any disclaimer, the term of this patent is extended or adjusted under 35 U.S.C. 154(b) by 0 days.

(21) Appl. No.: 13/142,524

(22) PCT Filed: Mar. 23, 2010

(86) PCT No.: PCT/US2010/028326
§ 371 (c)(1),
(2), (4) Date: Sep. 27, 2011

(87) PCT Pub. No.: WO2010/111273
PCT Pub. Date: Sep. 30, 2010

(65) Prior Publication Data
US 2012/0034258 A1 Feb. 9, 2012

Related U.S. Application Data

(60) Provisional application No. 61/210,772, filed on Mar. 23, 2009.

(51) Int. Cl.
*A61K 39/085* (2006.01)
*A61P 37/04* (2006.01)
*C07K 14/31* (2006.01)
*A61K 38/00* (2006.01)

(52) U.S. Cl.
CPC .......... *C07K 14/31* (2013.01); *A61K 39/085* (2013.01); *A61K 38/00* (2013.01)

(58) Field of Classification Search
None
See application file for complete search history.

(56) References Cited

U.S. PATENT DOCUMENTS

| | | | |
|---|---|---|---|
| 4,981,685 A | 1/1991 | Healey | |
| 5,538,733 A | 7/1996 | Emery et al. | |
| 5,554,372 A | 9/1996 | Hunter | |
| 5,830,479 A | 11/1998 | Emery et al. | |
| 5,906,826 A | 5/1999 | Emery et al. | |
| 6,027,736 A | 2/2000 | Emery et al. | |
| 6,288,214 B1 | 9/2001 | Hook et al. | |
| 6,432,412 B1 | 8/2002 | Emery et al. | |
| 6,680,195 B1 | 1/2004 | Patti et al. | |
| 6,682,754 B2 | 1/2004 | Emery et al. | |
| 6,692,739 B1 | 2/2004 | Patti et al. | |
| 6,703,025 B1 | 3/2004 | Patti et al. | |
| 6,720,160 B2 | 4/2004 | Wolde-Mariam | |
| 6,841,154 B2 | 1/2005 | Foster et al. | |
| 7,138,124 B2 | 11/2006 | Emery et al. | |
| 7,138,125 B2 | 11/2006 | Emery et al. | |
| 7,147,857 B2 | 12/2006 | Emery et al. | |
| 7,148,191 B2 | 12/2006 | Egyed et al. | |
| 7,160,549 B2 | 1/2007 | Emery et al. | |
| 7,341,732 B2 | 3/2008 | Emery et al. | |
| 7,371,393 B2 | 5/2008 | Emery et al. | |
| 7,413,743 B2 | 8/2008 | Emery et al. | |
| 7,943,150 B2 | 5/2011 | Emery et al. | |
| 7,943,151 B2 | 5/2011 | Emery et al. | |
| 8,007,803 B2 | 8/2011 | Emery et al. | |
| 8,007,811 B2 | 8/2011 | Emery et al. | |
| 8,021,885 B2 | 9/2011 | Emery et al. | |
| 8,025,885 B2 | 9/2011 | Emery et al. | |
| 8,119,147 B2 | 2/2012 | Emery et al. | |
| 8,282,941 B2 | 10/2012 | Emery et al. | |
| 8,425,916 B2 | 4/2013 | Emery et al. | |
| 8,575,315 B2 | 11/2013 | Emery et al. | |
| 8,637,048 B2 | 1/2014 | Emery et al. | |
| 8,709,436 B2 | 4/2014 | Emery et al. | |
| 8,709,760 B2 | 4/2014 | Emery et al. | |
| 2002/0061569 A1* | 5/2002 | Haselbeck et al. | 435/183 |
| 2003/0036639 A1 | 2/2003 | Emery et al. | |
| 2003/0064073 A1 | 4/2003 | Emery et al. | |
| 2003/0186364 A1 | 10/2003 | Bailey et al. | |
| 2003/0206922 A1 | 11/2003 | Emery et al. | |
| 2003/0211118 A1 | 11/2003 | Emery et al. | |
| 2004/0197350 A1 | 10/2004 | Emery et al. | |
| 2004/0197869 A1 | 10/2004 | Emery et al. | |
| 2004/0265329 A1 | 12/2004 | Emery et al. | |
| 2005/0037444 A1* | 2/2005 | Meinke et al. | 435/7.23 |
| 2005/0095682 A1 | 5/2005 | Straub et al. | |
| 2005/0186217 A1 | 8/2005 | Emery et al. | |

(Continued)

FOREIGN PATENT DOCUMENTS

| | | | |
|---|---|---|---|
| JP | 2005-502326 A | 1/2005 | |
| JP | 2008-532935 A | 8/2008 | |

(Continued)

OTHER PUBLICATIONS

Morath et al. J. Exp. Med. 193: 393-397, 2001.*
Bekeredjian-Ding et al. J. Immunol. 178: 2803-2812, 2007.*
U.S. Appl. No. 61/210,772 dated Mar. 23, 2009.
International Search Report and Written Opinion from application No. PCT/US2010/028326, dated Aug. 30, 2010; 13 pages.
International Preliminary Report on Patentability from application No. PCT/US2010/028326, dated Sep. 27, 2011; 9 pages.
Ando et al., "Characterization of the Role of the Divalent Metal Ion-Dependent Transcriptional Repressor MntR in the Virulence of *Staphylococcus aureus*," *Infect. Immun.*, May 2003; 71(5):2584-2590.
Anstead et al., "Recent advances in the treatment of infections due to resistant *Staphylococcus aureus*," *Curr. Opin. Infect.*, 2004; 17:549-555.

(Continued)

*Primary Examiner* — S. Devi
(74) *Attorney, Agent, or Firm* — Mueting, Raasch & Gebhardt, PA

(57) ABSTRACT

The present invention provides isolated polypeptides isolatable from a *Staphylococcus* spp. Also provided by the present invention are compositions that include one or more of the polypeptides, and methods for making and methods for using the polypeptides.

7 Claims, 143 Drawing Sheets

(56) References Cited

U.S. PATENT DOCUMENTS

Figure 1:
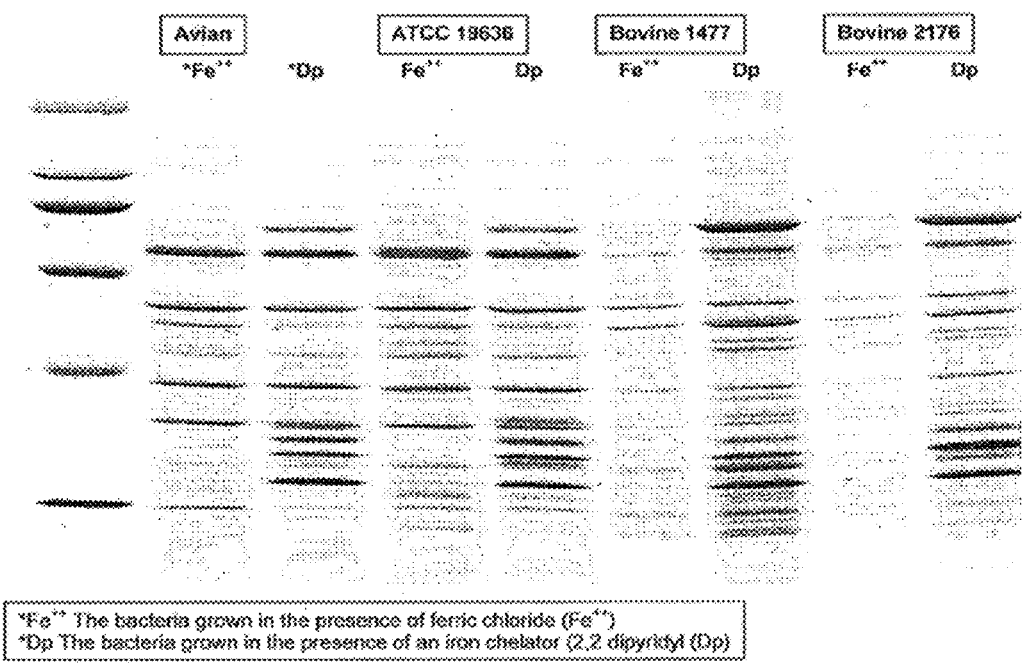

| | | | |
|---|---|---|---|
| 2006/0024323 | A1 | 2/2006 | Emery et al. |
| 2006/0115490 | A1 | 6/2006 | Masignani et al. |
| 2006/0165718 | A1 | 7/2006 | Emery et al. |
| 2006/0233824 | A1 | 10/2006 | Emery et al. |
| 2007/0087011 | A1 | 4/2007 | Emery et al. |
| 2007/0128183 | A1 | 6/2007 | Meinke et al. |
| 2008/0200650 | A1 | 8/2008 | Emery et al. |
| 2010/0111903 | A1 | 5/2010 | Emery et al. |
| 2012/0003269 | A1 | 1/2012 | Emery et al. |
| 2012/0195899 | A1 | 8/2012 | Emery et al. |
| 2013/0217048 | A1 | 8/2013 | Emery et al. |

FOREIGN PATENT DOCUMENTS

| | | |
|---|---|---|
| WO | WO 90/12591 A1 | 11/1990 |
| WO | WO 95/21627 A1 | 8/1995 |
| WO | WO 96/01620 A1 | 1/1996 |
| WO | WO 01/37810 A2 | 5/2001 |
| WO | WO 01/37810 A3 | 5/2001 |
| WO | WO 02/053180 A2 | 7/2002 |
| WO | WO 02/053180 A3 | 7/2002 |
| WO | 2002/059148 A2 | 8/2002 |
| WO | WO 02/059148 A9 | 10/2002 |
| WO | WO 02/094868 A2 | 11/2002 |
| WO | WO 03/020875 A2 | 3/2003 |
| WO | WO 03/020875 A3 | 10/2003 |
| WO | WO 04/013166 A2 | 2/2004 |
| WO | WO 04/013166 A3 | 4/2004 |
| WO | WO 06/021893 A2 | 3/2006 |
| WO | 2006/059247 A2 | 6/2006 |
| WO | WO 06/021893 A3 | 6/2006 |
| WO | WO 06/088803 A2 | 8/2006 |
| WO | WO 06/088803 A3 | 12/2006 |
| WO | WO 2010/111273 A1 | 9/2010 |

OTHER PUBLICATIONS

"ATCC No. 19636," organism: *Staphylococcus aureus* subsp. *aureus* Rosenbach; designation: Smith [ATCC 13709] [online]; Manassas, VA Jan. 12, 2012 from the Internet. Retrieved from the Internet:<URL:http:www.atcc.org/atccAdvancedCatalogSearch>; 1 pgs.

"ATCC No. 25904," organism: *Staphylococcus aureus* sugbsp. *aureus* Rosenbach; designation: Newman D2C [NCTC 10833] [online]; Manassas, VA Jan. 12, 2012 from the Internet. Retrieved from the Internet:<URL:http:www.atcc.org/atcAdvancedCatalogSearch>; 1 pg.

Baker et al., "Intravenous Immune Globulin for the Prevention of Nosocomial Infection in Low-Birth-Weight Neonates," N Engl. J Med, Jul. 13, 1992; 327(4):213-219.

Bloom et al., "Multicenter Study to Assess Safety and Efficacy of INH-A21, a Donor-Selected Human Staphylococcal Immunoglobulin, for Prevention of Nosocomial Infections in Very Low Birth Weight Infants," *Pediatr Infect Dis J*, Oct. 2005; 24(10):858-866.

Boulianne et al., "Production of functional chimaeric mouse/human antibody," *Nature*, Dec. 13, 1984; 312(5995):643-646.

Brouillette et al., "DNA immunization against the clumping factor A (ClfA) of *Staphylococcus aureus*," *Vaccine*, 2002; 20(17-18):2348-2357.

Brüggeman and Taussig, "Production of human antibody repertoires in transgenic mice," *Curr Opin Biotechnol.*, Aug. 1997; 8(4):455-458.

Brown et al., "Characterization of Pit, a *Streptococcus pneumoniae* Iron Uptake ABC Transporter," *Infect. Immun.*, Aug. 2002; 70(8):4389-4398.

Bunce et al., "Murine Model of Cutaneous Infection with Gram-Positive Cocci," *Infect. Immun.*, Jul. 1992; 60(7):2636-2640.

Capparelli et al., "Multicenter Study to Determine Antibody Concentrations and Assess the Safety of Administration of INH-A21, a donor-selected Human Staphylococcal Immune Globulin, in Low-Birth-Weight Infants," *Antimicrob Agents Chemother*, Oct. 2005; 49(10):4121-4127.

Clarke et al., "IsdA of *Staphylococcus aureus* is a broad spectrum, iron-regulated adhesin" *Mol. Microbiol.*, Mar. 2004; 51(5):1509-1519.

Cockayne et al., "Molecular Cloning of a 32-Kilodalton Lipoprotein Component of a Novel Iron-Regulated *Staphylococcus epidermidis* ABC Transporter," *Infect. Immun.*, Aug. 1998; 66(8):3767-3774.

Colman, "Effects of amino acid sequence changes on antibody-antigen interactions," *Research in Immunology*, 1994; 145:33-36.

Cottrell et al., "Protein Identification by Peptide Mass Fingerprinting," *Peptide Research*, 1994; 7(3):115-124.

Courcol et al., "Effects of iron depletion and sub-inhibitory concentrations of antibiotics on siderophore production by *Staphylococcus aureus*," *Journal of Antimicrobial Chemotherapy*, 1991; 28:663-668.

Courcol et al., "Siderophore production by *Staphylococcus aureus* and identification of iron-regulated proteins," *Infection and Immunity*, May 1997; 65(5):1944-1948.

Dale et al., "Role of Siderophore Biosynthesis in Virulence of *Staphylococcus aureus*: Identification and Characterization of Genes Involved in Production of a Siderophore," *Infect. Immun.*, Jan. 2004; 72(1):29-37.

Dale et al., "Involvement of SirABC in Iron-Siderophore Import in *Staphylococcus aureus*," *J. Bacteria*, Dec. 2004; 186(24):8356-8362.

Darenberg et al., "Differences in Potency of Intravenous Polyspecific Immunoglobulin G against Streptococcal and Staphlococcal Superantigens: Implications for Therapy of Toxic Shock Syndrome," *Clin Infect Dis*, Mar. 15, 2004; 38(6):836-842.

Daugherty et al., "Polymerase chain reaction facilitates the cloning, CDR-grafting, and rapid expression of a murine monoclonal antibody directed against the CD18 component of leukocyte integrins," *Nucleic Acids Research*, May 11, 1991; 19(9):2471-2476.

Definition of symptom and sign. Dorland's Medical Dictionary. Http://www.mercksource.com. Retrieved online Jun. 7, 2007 and Jun. 8, 2007.

Diarra et al., "Response of *Staphylococcus aureus* Isolates from Bovine Mastitis to Exogenous Iron Sources," *J. Dairy Sci.*, 2002; 85(9):2141-2148.

Domanski et al., "Characterization of a Humanized Monoclonal Antibody Recognizing Clumping Factor A Expressed by *Staphylococcus aureus*," *Infect Immun*, Aug. 2005; 73(8):5229-5232.

Drechsel et al., "Purification and chemical characterization of staphyloferrin B, a hydrophilic siderophore from staphylococci" *Biometals*, 1993; 6:185-1992.

Dryla et al., "Comparison of antibody repertoires against *Staphylococcus aureus* in Healthy individuals and in Acutely Infected Patients," *Clinical and Diagnostic Laboratory Immunology*, Mar. 2005; 12(3):387-398.

Durfee, "Classification of 110 Strains of *Staphylococcus Aureus*," *J. Bacteriol*, Nov. 1942; 44(5):589-595.

Ellis, "New Technologies for Making Vaccines," Chapter 29 in Vaccines, Philadelphia, PA, 1988; cover page, title page and Chapter 29, 10 pages.

Fattom et al., "Development of StaphyVAX™, a polysaccharide conjugate vaccine against *S. aureus* infection: from the lab bench to the phase III clinical trials," *Vaccine*, Feb. 17, 2004; 22(7):880-887.

Foster et al., "Surface protein adhesins of *Staphylococcus aureus*" *Trends Microbiol.*, 1998; 6:Title page, Publication page, and pp. 484-488.

Gampfer et al., "Epitope mapping of neutralizing TSST-1 specific antibodies induced by immunization with toxin or toxoids," *Vaccine*, Nov. 1, 2002; 20(31-32):3675-3684.

Geret et al., "Vaccination against staphylococcal infections in animal experiments," *Helvetica Chirurgica Acta*, 1979; 46(1-2):167-169.

Giddings et al., "Genome-based peptide fingerprint scanning," *PNAS*, 2003; 100(1):20-25.

Greenspan et al., "Defining Epitopes: It's not as easy as it seems," *Nature Biotechnology*, Oct. 1999; 17:936-937.

(56) References Cited

OTHER PUBLICATIONS

Hall et al., "Characterization of a Protective Monoclonal Antibody Recognizing *Staphylococcus aureus* MSCRAMM Protein Clumping Factor A," *Infect Immun*, Dec. 2003; 71(12):6864-6870.

Harlow et al., Antibodies, A Laboratory Manual, "Antibody-Antigen Interactions," Chapter 3, Cold Spring Harbor Laboratory, Cold Spring Harbor, NY, 1988; cover page, copyright page and pp. 23-25, 27-33.

Harlow et al., Antibodies, A Laboratory Manual, "Immunizations," Chapter 5, Cold Spring Harbor Laboratory, Cold Spring Harbor, New York, NY, 1988; cover page, copyright page, table of contents, and pp. 53-137.

Heinrichs et al., "Identification and characterization of SirA, an iron-regulated protein from *Staphylococcus aureus*" *J. Bacteriol.*, Mar. 1999; 181(5):1436-1443.

Henzel et al., "Identifying proteins from two-dimensional gels by molecular mass searching of peptide fragments in protein sequence databases," *PNAS USA*, 1993; 90:5011-5015.

Herron-Olson, Lisa, "Molecular correlates of host-specific adaptation in *Staphylococcus aureus* associated with bovine mastitis and human toxic shock syndrome," A Dissertation submitted to the Faculty of the Graduate School of the University of Minnesota, Jul. 2005; 200 pgs.

Hill, H., "Additional confirmation of the lack of effect of intravenous immunoglobulin in the prevention of neonatal infection," *J Pediatr*, 2000; 137(5):595-597.

Hill et al., "SirR, a Novel Iron-Dependent Repressor in *Staphylococcus epidermis*" *Infect. Immun.*, Sep. 1998; 66(9):4123-4129.

Holden et al., "Complete genomes of two clinical *Staphylococcus aureus* strains: Evidence for the rapid evolution of virulence and drug resistance," *PNAS USA*, 2004; 101(26):9786-9791.

Horsburgh et al., "In *Staphylococcus aureus*, Fur Is an Interactive Regulator with PerR, Contributes to Virulence, and Is Necessary for Oxidative Stress Resistance through Positive Regulation of Catalase and Iron Homeostasis" *J. Bacteriol.*, Jan. 2001; 183(2):468-475.

Houghten et al., "Relative Importance of Position and Individual Amino Acid Residues in Peptide Antigen-Antibody Interactions: Implications in the Mechanism of Antigenic Drift and Antigenic shift," *Vaccines 86, New Approaches to Immunization*, Cold Spring Harbor Laboratory, Cold Spring Harbor, NY, 1986; cover page, copyright page, and pp. 21-25.

Hussain et al., "A Lithium Chloride-Extracted, Broad-Spectrum-Adhesive 42-Kilodalton Protein of *Staphylococcus epidermidis* is Ornithine Carbomoylotransferase" [online] *Infection and Imunnity*, Dec. 1999; 67(12):6688-6690. [retrieved on Jul. 12, 2002]. Retrieved from the Internet:<URL:http://iai.asm.org/cgi/content/full/67/12/6668?view=full&pmid=10569792>. 8 pgs.

Joiner et al., "A Quantitative Model for Subcutaneous Abscess Formation in Mice" *Br. J. Exp. Pathol*. Feb. 1980; 61(1):97-107.

Jones et al., "Replacing the complementarity-determining regions in a human antibody with those from a mouse," *Nature*, May 29, 1986;321(6069):522-525.

Kaplan, "Treatment of Community-Associated Methicillin-Resistant *Staphylococcus aureus* Infections," *The Pediatric Infectious Disease Journal*, May 2005; 24(5):457-458.

Kim et al., "IsdA and IsdB antibodies protect mice against *Staphylococcus aureus* abscess formation and lethal challenge," *Vaccine*, Aug. 31, 2010; 28(38):6382-6392.

Konetschny-Rapp et al., "Staphyloferrin A: a structurally new siderophore from staphylococci" *Eur. J. Biochem.*, 1990; 191:65-74.

Kuklin et al., "A novel *Staphylococcus aureus* Vaccine: Iron Surface Determinant B Induces Rapid Antibody Response in Rhesus Macaques and Specific Increased Survival in a Murine *S. aureus* Sepsis Model, " *Infection and Immunity*, Apr. 2006;74(4):2215-2223.

Leitner et al., "Development of a *Staphylococcus aureus* vaccine against mastitis in dairy cows. II. Field trial" *Veterinary Immunology and Immunopathology*, 2003; 93:153-158.

Liebler, *Introduction to Proteomics: Tools for the New Biology*, Humana Press, Totowa, NJ, 2002; cover page, title page, and pp. 77-82.

Lin et al., "Th1-Th17 Cells Mediate Protective Adaptive Immunity against *Staphylococcus aureus* and *Candida albicans* Infection in Mice," *PLOS Pathogens*, Dec. 2009; 5(12):1-10.

Lindsay et al., "*Staphylococcus aureus* but not *Staphylococcus epidermidis* can acquire iron from transferrin" *Microbiology*, Jan. 1995; 141(Pt 1):197-203.

Lindsay et al., "Staphylococcal iron requirements, siderophore production, and iron-regulated protein expression" *Infection and Immunity*, Jun. 1994; 62(6):2309-2314.

Lipman et al., "Rapid and Sensitive Protein Similarity Searches," *Science*, 1985; 227:1435-1441.

LoBuglio et al., "Mouse/human chimeric monoclonal antibody in man: Kinetics and immune response," *PNAS USA*, Jun. 1989; 86(11):4220-4224.

Lonberg and Huszar, "Human Antibodies from Transgenic Mice," *Int Rev Immunol.*, 1995; 13(1):65-93.

Lonberg et al., "Antigen-specific human antibodies from mice comprising four distinct genetic modifications," *Nature*, 1994; 368(6474): 856-859.

Lowell et al., "Immunogenicity and Efficacy Against Lethal Aerosol Staphylococcal Enterotoxin B Challenge in Monkeys by Intramuscular and Respiratory Delivery of proteasome-toxoid vaccines," *Infect Immun.*, Nov. 1996; 64(11):4686-4693.

Maira-Litran et al., "Immunochemical Properties of the Staphylococcal Poly-N-Acetylglucosamine Surface Polysaccharide," *Infect Immun*, Aug. 2002; 70(8):4433-4440.

Maira-Litran et al., "Biologic properties and vaccine potential of the staphylococcal poly-N-acetyl glucosamine surface polysaccharide," *Vaccine*, 2004; 22:872-879.

Maira-Litran et al., "Comparative Opsonic and Protective Activities of *Staphylococcus aureus* Conjugate Vaccines Containing Native or Deacetylated Staphylococcal Poly-N-Acetyl-β-(1-6)-Glucosamine," *Infect Immun.*, Oct. 2005; 73(10):6752-6762.

Mazmanian et al., "Passage of Heme-Iron Across the Envelope of *Staphylococcus aureus*" *Science*, Feb. 7, 2003; 299(5608):906-909.

Mazmanian et al., "An iron-regulated sortase anchors a class of surface protein during *Staphylococcus aureus* pathogenesis" *PNAS USA*, Feb. 19, 2002; 99(4):2293-8.

McKenney et al., "Broadly Protective Vaccine for *Staphylococcus aureus* Based on an in Vivo-Expressed Antigen," *Science*, May 28, 1999;284:1523-1527.

McKenney et al., "Vaccine potential of poly-1-6 beta-D-N-succinylglucosamine, an immunoprotective surface polysaccharide of *Staphylococcus aureus* and *Staphylococcus epidermidis* " *J. Biotechnol.*, Sep. 29, 2000; 83(1-2):37-44.

Mendoza et al., "Identification of *Staphyloccus* species by 16S-23S rDNA intergenic spacer PCR analysis," *I'ntl J. Systematic Bacteriology*, 1998; 48:1049-1055.

Menzies et al., "Inhibition of Staphylococcal Wound Infection and Potentiation of Antibiotic Prophylaxis by a Recombinant Fragment of the Fibronectin-Binding Protein of *Staphylococcus aureus*," *J Infect Dis*, Apr. 1, 2002;185:937-943.

Miller et al., "Ensuring the pathogen safety of intravenous immunoglobulin and other human plasma-derived therapeutic proteins," *J Allergy Clin Immunol*, Oct. 4, 2001;108(4):S91-94.

Modun et al., "The *Staphylococcus aureus* and *Staphylococcus epidermidis* transferrin-binding proteins are expressed in vivo during infection" *Microbiology*, Apr. 1998; 144(Pt 4):1005-12.

Modun et al., "Staphylococci Express a Receptor for Human Transferrin: Identification of a 42-Kilodalton Cell Wall Transferrin-Binding Protein" *Infect. Immun.*, Sep. 1994; 62(9):3850-3858.

Morrissey et al., "The Staphylococcal Ferritins are Differentially Regulated in Response to Iron and Manganese and via PerR and Fur" *Infect. Immun.*, Feb. 2004; 72(2):972-979.

Morrissey et al., "Conservation, Surface Exposure, and In Vivo Expression of the Frp Family of Iron-Regulated Cell Wall Proteins in *Staphylococcus aureus* " *Infect. Immun.*, May 2002; 70(5):2399-2407.

(56) References Cited

OTHER PUBLICATIONS

Morrissey et al., "Molecular Cloning and Analysis of a Putative Siderophore ABC Transporter from *Staphylococcus aureus*" *Infect. Immun.*, Nov. 2000; 68(11):6281-6288.

Morrison et al., "Chimeric human antibody molecules: Mouse antigen-binding domains with human constant region domains," *PNAS USA*, Nov. 1984;81(21):6851-6855.

NCBI (National Center for Biotechnology Information) accession No. YP_416181/GI: 825750440, first available Nov. 29, 2005.

NCBI (National Center for Biotechnology information) accession No. NP_373946.1/GI: 15926413, first available Oct. 4, 2001.

Nilsson et al., "Vaccination with a Recombinant Fragment of Collagen Adhesin Provides Protection against *Staphylococcus Aureus*-mediated Septic Death," *J Clin Invest*, Jun. 15, 1998; 101(12):2640-2649.

Ohwada et al., "DNA Vaccination by *mecA* sequence evokes an antibacterial immune response against methicillin-resistant *Staphylococcus aureus*," *J Antimicrob Chemother*, Dec. 1999;44(6):767-774.

Pengov et al., "Antimicrobial Drug Susceptibility of *Staphylococcus aureus* Strains Isolated from Bovine and Ovine Mammary Glands," *J.Dairy Sci*, 2003; 86:3157-3163.

Perkins et al., "Probability-based protein identification by searching sequence databases using mass spectrometry data," *Electrohporesis*, Dec. 1, 1999;20(18):3551-3567.

Poelstra et al., "Surgical Irrigation with Pooled Human Immunoglobulin G to Reduce Post-Operative Spinal Implant Infection," *Tissue Eng*, Aug. 2000;6(4):401-411.

Poutrel et al., "Reactivity of Coagulase-Negative Staphylococci Isolated from Cow and Goat Milk with Monoclonal Antibodies to *Staphylococcus aureus* Capsular Polysaccharide Types 5 and 8" *J. Clinical Microbiology*, 1990; 28(2):358-360.

Projan et al., "Staphylococcal vaccines and immunotherapy: to dream the impossible dream?" *Current Opinion in Pharmacology*, 2006; 6:473-479.

Queen et al., "A humanized antibody that binds to the interleukin 2 receptor," *PNAS USA*, Dec. 1989;86(24):10029-10033.

Reinoso et al., "Bovine and rabbit models for the study of a *Staphylococcus aureus* avirulent mutant strain, RC122," *Can J Vet Res*, Oct. 2002; 66(4):285-288.

Riechmann et al., "Reshaping human antibodies for therapy," *Nature*, Mar. 24, 1988; 332(6162):323-327.

Sacher, "Intravenous immunoglobulin consensus statement," *J Allergy Clin Immunol*, Oct. 2001; 108(4 Suppl): S139-146.

Schievert, "Use of intravenous immunoglobulin in the treatment of staphylococcal and streptococcal toxic shock syndromes and related illnesses," *J Allergy Clin Immunol*, Oct. 2001; 108(4 Suppl):S107-110.

Sebulsky et al., "Identification and Characterization of *fhuD1* and *fhuD2*, Two Genes Involved in Iron-Hydroxamate Uptake in *Staphylococcus aureus*" *J. Bacteriol.*, Sep. 2001; 183(17):4994-5000.

Sebulsky et al., "Identification and Characterization of a Membrane Permease Involved in Iron-Hydroxamate Transport in *Staphylococcus aureus*" *J. Bacteriol.*, Aug. 2000; 182(16):4394-4400.

Senna et al., "Protective immune response against methicillin resistant *Staphylococcus aureus* in a murine model using a DNA vaccine approach," *Vaccine*, Jun. 2, 2003; 21(19-20):2661-2666.

Smith et al., "Environmentally regulated genes of *Streptococcus suis*: identification by the use of iron-restricted conditions *in vitro* and by experimental infection of piglets" *Microbiology*, Feb. 2001; 147(Pt 2):271-280.

Staphylococcal Infections. Merck Manual Home Edition. Retrieved online Jun. 7, 2007. Retrieved from the Internet: <URL:http://www.merck.com/mmhe>; 2 pgs.

Spellberg et al., "The Antifungal Vaccine Derived from the Recombinant N Terminus of A1s3p Protects Mice against the Bacterium *Staphylococcus aureus*," *Infection and Immunity*, Oct. 2008; 76(10):4574-4580.

Stiles et al., "Mucosal Vaccination with Recombinantly Attenuated Staphylococcal Enterotoxin B and Protection in a Murine Model," *Infect Immun*, Apr. 2001;69(4):2031-2036.

Stohl et al., "Human T Cell-Dependent B Cell Differentiation Induced by Staphylococcal superantigens," *J Immunol*, Jul. 1, 1994;153(1):117-127.

Stohl et al., "Differential Human T Cell-Dependent B Cell Differentiation Induced by Staphylococcal Superantigens (SAg). Regulatory Role for SAg-Dependent B Cell Cytolysis," *J Immunol.*, Aug. 15, 1995; 155(4):1838-1850.

Stohl and Elliot, "In Vitro Inhibition by Intravenous Immunoglobulin of Human T Cell-Dependent B Cell Differentiation Induced by Staphylococcal Superantigens," *Clin Immunol Immunopathol*, 1996; 79:122-133.

Stoppler et al., "Staph Infection (*Staphylococcus aureus*)" [online]. MedicineNet, Inc., San Clemente, CA, Copyright 2008 [retrieved Mar. 6, 2008]. Retrieved from the internet: <URL:http://www.medicinenet.com/script/main/art.asp?articlekey=1991&pf=3&page=2>; 4 pgs.

Stranger-Jones,"Vaccine assembly from surface proteins of *Staphylococcus aureus*," *PNAS USA*, Nov. 7, 2006; 103(45):16942-16947.

Takei et al., "Intravenous Immunoglobulin Contains Specific Antibodies Inhibitory to Activation of T Cells by Staphylococcal Toxin Superantigens," *J Clin Invest*, Feb. 1, 1993; 91(2):602-607.

Taylor et al., "A transgenic mouse that expresses a diversity of human sequence heavy and light chain immunoglobulins," *Nucleic Acids Research*, Dec. 11, 1992;20(23):6287-6295.

Tatusova et al., "Blast 2 Sequences, a new tool for comparing protein and nucleotide sequences," *FEMS Microbiol Lett.*, May 15, 1999; 174(2):247-50.

Todar's Online Textbook of Bacteriology, "The Bacterial Flora of Humans," 2002. Retrieved May 11, 2007 from http//www.textbookofbacteriology.net/normalflora.html.

Trivier et al., "Influence of iron depletion on growth kinetics, siderophore production, and protein expression of *Staphylococcus aureus*" *FEMS Microbiol. Lett.*, Apr. 1, 1995; 127(3):195-199.

van der Zee et al., "Molecular Genotyping of *Staphylococcus aureus* Strains: Comparison of Repetitive Element Sequence-Based PCR with Various Typing Methods and Isolation of a Novel Epidemicity Marker," *Journal of Clinical Microbiology*, Feb. 1999; 37(2):342-349.

Verhoef et al. "Prospects for Monoclonal Antibodies in the Diagnosis and Treatment of Bacterial Infections," *Eur. J. Clin. Microbiol.* Infect. Dis., 1990; 9(4):247-250.

Verhoeyen et al., "Reshaping Human Antibodies: Grafting an Antilysozyme Activity," *Science*, Mar. 25, 1988; 239(4847):1534-1536.

Vernachio et al., "Anti-Clumping Factor A Immunoglobulin Reduces the Duration of Methicillin-Resistant *Staphylococcus aureus* Bacteremia in an Experimental Model of Infective Endocarditis," *Antimicrob Agents Chemother*, Nov. 2003; 47(11):3400-3406.

Vytvytska et al., "Identification of vaccine candidate antigens of *Staphylococcus aureus* by serological proteome analysis," *Proteomics*, 2002; 2:580-590.

Wysocki et al., "Receptors for Endogenous and Heterogenous Hydroxamate Siderophores in *Staphylococcus aureus* B 47," *Pol. J. Microbiol.*, 2005; 54:97-103.

Xiong et al., "Molecular characterization of the ferric-uptake regulator, Fur, from *Staphylococcus aureus*" *Microbiology*, 2000; 146(Pt 3):659-668.

Clements et al., "Antibiotic Activity and Characterization of BB-3497, a Novel Peptide Deformylase Inhibitor," *Antimicrobial Agents and Chemotherapy*, 2001; 45(2): 563-570.

Extended European Search Report dated Aug. 22, 2012, in European Patent Application No. 10756718.2, filed Mar. 23, 2010.

U.S. Appl. No. 13/362,992 dated Jan. 31, 2012, Emery et al.

International Search Report and Written Opinion for PCT Appln. No. PCT/US2006/005058, dated Oct. 11, 2006; 17 pgs.

Amorena et al., "Use of liposome-immunopotentiated exopolysaccharide as a component of an ovine mastitis staphococcal vaccine" *Vaccine*, 1994; 12(3):243-249.

(56) References Cited

OTHER PUBLICATIONS

Anderson et al., "*Staphylococcus aureus* Manganese Transport Protein C Is a Highly Conserved Cell Surface Protein That Elicits Protective Immunity Against *S. aureus* and *Staphylococcus epidermis*" *The Journal of Infectious Diseases*, Jun. 2012; 205:1688-1696.

Ausubel et al., eds., Current Protocols in Molecular Biology, John Wiley & Sons, Inc., 2002; cover pg., publication pg., and table of contents only (14 pgs).

Baba et al., "Genome and Virulence Determinants of High Virulence Community Acquired MRSA," *Lancet*, 2002; 359:1819-1827.

Bock et al., "Whole-proteome interaction mining," Bioinformatics, Jan. 2003;19(1):125-134.

Cerca et al., "Protection Against *Escherichia coli* Infection by Antibody to the *Staphylococcus aureus* poly-N-acetylglucosamine Surface Polysaccharide," *Proceedings of the National Academy of Sciences*, May 1, 2007; 104(18) 7528-7533.

Crichton, "Chapter 3. Microbial iron uptake and intracellular release" In: Inorganic Biochemistry of Iron Metabolism, Burgess, (ed), 1991, Ellis Horwood Limited, Chichester, England, Title page and pp. 59-76.

Crosa, "The Relationship of Plasmid-Mediated Iron Transport and Bacterial Virulence," Annu. Rev. Microbiol., 1984; 38:69-89.

Crosa, "Genetics and Molecular Biology of Siderophore-Mediated Iron Transport in Bacteria," Microbiol. Rev., Dec. 1989; 53(4):517-530.

Ferguson et al., "Siderophore-Mediated Iron Transport: Crystal Structure of FhuA with Bound Lipopolysaccharide," Science, Dec. 18, 1998; 282(5397):2215-2220.

Finkelstein et al., "Role of Iron in Microbe-Host Interactions," Rev. Infect. Dis., Sep-Oct. 1983; 5 Suppl 4: S759-776.

Furugouri, "Iron Binding Substances in the Intestinal Mucosa of Neonatal Piglets," J Nutr. Mar. 1977; 107(3):487-494.

Gilleland, Jr. et al., "Perspectives on the Potential for Successful Development of Outer Membrane Protein Vaccines," Eur. J. Clin. Microbiol., Jun. 1987;6(3):231-233. (0039 added "Review. (No abstract available.)").

Greenbaum et al., "Towards a Consensus on Datasets and Evaluation Metrics for Developing B-cell epitope Prediction Tools," *Journal of Molecular Recognition*, 2007; 20(2):75-82.

Herbert, "Dictionary of Immunology," Fourth Edition, Academic Press, 1995, pp. 58-59.

Jiang et al., "Ligand-Specific Opening of a Gated-Porin Channel in the Outer Membrane of Living Bacteria," Science, May 1997, 276:1261-1264.

Koebnik et al., "Structure and function of bacterial outer membrane proteins: barrels in a nutshell," Molecular Microbiology, 2000, 37/2:239-253.

Neilands, "Microbial Iron Compounds," Ann. Rev. Biochem., 1981; 50:715-731.

Neilands, "Microbial Envelope Proteins Related to Iron," Ann. Rev. Microbiol., 1982; 36:285-309.

*UniProt Accession No.*: National Center for Biotechnology Information, National Library of Medicine, National Institutes of Health, GenBank Locus O87491_STAAU, Accession No. O87491, "Lipoprotein SirA," [online]. Bethesda, MD [retrieved on May 8, 2014]. Retrieved from the Internet:<URL: http://www.ncbi.nlm.nih.gov/protein/O87491>; 1pg.

*UniProt Accession No.*: National Center for Biotechnology Information, National Library of Medicine, National Institutes of Health, GenBank Locus Q8NUX1_STAAW, Accession No. Q8NUX1, "Oligopeptide Transporter Putative Substrate Binding Domain," [online]. Bethesda, MD [retrieved on May 8, 2014]. Retrieved from the Internet:<URL: http://www.ncbi.nlm.nih.gov/protein/Q8NUX1>; 1pg.

van der Helm, "Physical Biochemistry of FEPA and other Siderophore Receptor Proteins," J. Inorg. Biochem., 1995;59(2-3):90 (abstract only).

David, "Help from 'friendly' bacteria" Oct. 2009 *Nature Reviews Microbiology*, 7:688.

Dryla, "Identification of a novel iron regulated staphylococcal surface protein with haptoglobin-haemoglobin binding activity" Jul. 2003 *Mol. Microbiol.*, 49(1):37-53.

Tatusova et al., Correction to "Blast 2 Sequences, a new tool for comparing protein and nucleotide sequences" 1999 *FEMS Microbiol Lett*, 174:247-250.

Cohen, "Modified Biochemical Tests for Characterization of L-Phase Variants of Bacteria" Nov. 1968 *Appl. Microbiology*, 16(11):1655-1662.

\* cited by examiner

Kaplan-Meier survival curve showing percent survival after vaccination and homologous challenge with *S. aureus* ATCC19636

Kaplan-Meier survival curve showing percent survival after vaccination and heterologous challenge with *S. aureus* ATCC19636

Kaplan-Meier survival curve showing percent survival after passive immunization and homologous challenge with *S. aureus* ATCC19636

Kaplan-Meier survival curve showing percent survival after passive immunization and heterologous challenge with *S. aureus* 1477

Figure 7

LETNKNHATAWQGFKNGRWNRHVDVREFIQLNYTLYEGNDSFLAGPTEATSKL
WEQVMQLSKEERERGGMWDMDTKVASTITSHDAGYLDKDLETIVGVQTEKPFK
RSMQPFGGIRMAKAACEAYGYELDEETEKIFTDYRKTHNQGVFDAYSREMLNCR
KAGVITGLPDAYGRGRIIGDYRRVALYGVDFLMEEKMHDFNTMSTEMSEDVIRL
REELSEQYRALKELKELGQKYGFDLSRPAENFKEAVQWLYLAYLAAIKEQNGAA
MSLGRTSTYLDIYAERDLKAGVITESEVQEIIDHFIMKLRIVKFARTPDYNELFSGD
PTWVTVSIGGVGIDGRPLVTKNSFRFLHSLDNLGPAPEPNLTVLWSVRLPDNFKTY
CAKMSIKTSSIQYENDDIMRESYGDDYGIACCVSAVTIGKQMQFFGARANIAKTLL
YAINGGKDEKSGAQVGPNFEGINSEVLEYDEVFKKFDQMMDWLAGVYINSLNVI
HYMHDKYSYERIEMALHDTEIVRTMATGIAGLSVAADSLSAIKYAQVKPIRNEEG
LVVDFEIEGDFPKYGNNDDRVDDIAVDLVERFMTKLRSHKTYRDSEHTMSVLTIT
SNVVYVKKTGNTPDGRKAGEPFAPGANPMHGRDQKGALSSLSSVAKIPYDCCKD
GISNTFSIVPKSLGKEPEDQNRNLTSMLDGYAMQCGHHLNINVFNRETLIDAMEHP
EEYPQLTIRVSGYAVNFIKLTREQQLDVISRTFHESM
(SEQ ID NO:353)

Figure 8

MLETNKNHATAWQGFKNGRWNRHVDVREFIQLNYTLYEGNDSFLAGPTEATSK
LWEQVMQLSKEERERGGMWDMDTKVASTITSHDAGYLDKDLETIVGVQTEKPF
KRSMQPFGGIRMAKAACEAYGYELDEETEKIFTDYRKTHNQGVFDAYSREMLNC
RKAGVITGLPDAYGRGRIIGDYRRVALYGVDFLMEEKMHDFNTMSTEMSEDVIR
LREELSEQYRALKELKELGQKYGFDLSRPAENFKEAVQWLYLAYLAAIKEQNGA
AMSLGRTSTFLDIYAERDLKAGVITESEVQEIIDHFIMKLRIVKFARTPDYNELFSG
DPTWVTESIGGVGIDGRPLVTKNSFRFLHSLDNLGPAPEPNLTVLWSVRLPDNFKT
YCAKMSIKTSSIQYENDDIMRESYGDDYGIACCVSAMTIGKQMQFFGARANLAKT
LLYAINGGKDEKSGAQVGPNFEGINSEVLEYDEVFKKFDQMMDWLAGVYINSLN
VIHYMHDKYSYERIEMALHDTEIVRTMATGIAGLSVAADSLSAIKYAQVKPIRNEE
GLVVDFEIEGDFPKYGNNDDRVDDIAVDLVERFMTKLRSHKTYRDSEHTMSVLTI
TSNVVYGKKTGNTPDGRKAGEPFAPGANPMHGRDQKGALSSLSSVAKIPYDCCK
DGISNTFSIVPKSLGKEPEDQNRNLTSMLDGYAMQCGHHLNINVFNRETLIDAME
HPEEYPQLTIRVSGYAVNFIKLTREQQLDVISRTFHESM
(SEQ ID NO:354)

Figure 9

MLETNKNHATAWQGFKNGRWNRHVDVREFIQLNYTLYEGNDSFLAGPTEATSK
LWEQVMQLSKEERERGGMWDMDTKVASTITSHDAGYLDKDLETIVGVQTEKPF
KRSMQPFGGIRMAKAACEAYGYELDEETEKIFTDYRKTHNQGVFDAYSREMLNC
RKAGVITGLPDAYGRGRIIGDYRRVALYGVDFLMEEKMHDFNTMSTEMSEDVIR
LREELSEQYRALKELKELGQKYGFDLSRPAENFKEAVQWLYLAYLAAIKEQNGA
AMSLGRTSTFLDIYAERDLKAGVITESEVQEIIDHFIMKLRIVKFARTPDYNELFSG
DPTWVTESIGGVGIDGRPLVTKNSFRFLHSLDNLGPAPEPNLTVLWSVRLPDNFKT
YCAKMSIKTSSIQYENDDIMRESYGDDYGIACCVSAMTIGKQMQFFGARANLAKT
LLYAINGGKDEKSGAQVGPNFEGINSEVLEYDEVFKKFDQMMDWLAGVYINSLN
VIHYMHDKYSYERIEMALHDTEIVRTMATGIAGLSVAADSLSAIKYAQVKPIRNEE
GLVVDFEIEGDFPKYGNNDDRVDDIAVDLVERFMTKLRSHKTYRDSEHTMSVLTI
TSNVVYGKKTGNTPDGRKAGEPFAPGANPMHGRDQKGALSSLSSVAKIPYDCCK
DGISNTFSIVPKSLGKEPEDQNRNLTSMLDGYAMQCGHHLNINVFNRETLIDAME
HPEEYPQLTIRVSGYAVNFIKLTREQQLDVISRTFHESM (SEQ ID NO:355)

Figure 10

MLETNKNHATAWQGFKNGRWNRHVDVREFIQLNYTLYEGNDSFLAGPTEATSK
LWEQVMQLSKEERERGGMWDMDTKVASTITSHDAGYLDKDLETIVGVQTEKPF
KRSMQPFGGIRMAKAACEAYGYELDEETEKIFTDYRKTHNQGVFDAYSREMLNC
RKAGVITGLPDAYGRGRIIGDYRRVALYGVDFLMEEKMHDFNTMSTEMSEDVIR
LREELSEQYRALKELKELGQKYGFDLSRPAENFKEAVQWLYLAYLAAIKEQNGA
AMSLGRTSTFLDIYAERDLKAGVITESEVQEIIDHFIMKLRIVKFARTPDYNELFSG
DPTWVTESIGGVGIDGRPLVTKNSFRFLHSLDNLGPAPEPNLTVLWSVRLPDNFKT
YCAKMSIKTSSIQYENDDIMRESYGDDYGIACCVSAMTIGKQMQFFGARANLAKT
LLYAINGGKDEKSGAQVGPNFEGINSEVLEYDEVFKKFDQMMDWLAGVYINSLN
VIHYMHDKYSYERIEMALHDTEIVRTMATGIAGLSVAADSLSAIKYAQVKPIRNEE
GLVVDFEIEGDFPKYGNNDDRVDDIAVDLVERFMTKLRSHKTYRDSEHTMSVLTI
TSNVVYGKKTGNTPDGRKAGEPFAPGANPMHGRDQKGALSSLSSVAKIPYDCCK
DGISNTFSIVPKSLGKEPEDQNRNLTSMLDGYAMQCGHHLNINVFNRETLIDAME
HPEEYPQLTIRVSGYAVNFIKLTREQQLDVISRTFHESM (SEQ ID NO:356)

Figure 11

MLETNKNHATAWQGFKNGRWNRHVDVREFIQLNYTLYEGNDSFLAGPTEATSK
LWEQVMQLSKEERERGGMWDMDTKVASTITSHDAGYLDKDLETIVGVQTEKPF
KRSMQPFGGIRMAKAACEAYGYELDEETEKIFTDYRKTHNQGVFDAYSREMLNC
RKAGVITGLPDAYGRGRIIGDYRRVALYGVDFLMEEKMHDFNTMSTEMSEDVIR
LREELSEQYRALKELKELGQKYGFDLSRPAENFKEAVQWLYLAYLAAIKEQNGA
AMSLGRTSTFLDIYAERDLKAGVITESEVQEIIDHFIMKLRIVKFARTPDYNELFSG
DPTWVTESIGGVGIDGRPLVTKNSFRFLHSLDNLGPAPEPNLTVLWSVRLPDNFKT
YCAKMSIKTSSIQYENDDIMRESYGDDYGIACCVSAMTIGKQMQFFGARANLAKT
LLYAINGGKDEKSGAQVGPNFEGINSEVLEYDEVFKKFDQMMDWLAGVYINSLN
VIHYMHDKYSYERIEMALHDTEIVRTMATGIAGLSVAADSLSAIKYAQVKPIRNEE
GLVVDFEIEGDFPKYGNNDDRVDDIAVDLVERFMTKLRSHKTYRDSEHTMSVLTI
TSNVVYGKKTGNTPDGRKAGEPFAPGANPMHGRDQKGALSSLSSVAKIPYDCCK
DGISNTFSIVPKSLGKEPEDQNRNLTSMLDGYAMQCGHHLNINVFNRETLIDAME
HPEEYPQLTIRVSGYAVNFIKLTREQQLDVISRTFHESM
(SEQ ID NO:357)

Figure 12

MLETNKNHATAWQGFKNGRWNRHVDVREFIQLNYTLYEGNDSFLAGPTEATSK
LWEQVMQLSKEERERGGMWDMDTKVASTITSHDAGYLDKDLETIVGVQTEKPF
KRSMQPFGGIRMAKAACEAYGYELDEETEKIFTDYRKTHNQGVFDAYSREMLNC
RKAGVITGLPDAYGRGRIIGDYRRVALYGVDFLMEEKMHDFNTMSTEMSEDVIR
LREELSEQYRALKELKELGQKYGFDLSRPAENFKEAVQWLYLAYLAAIKEQNGA
AMSLGRTSTFLDIYAERDLKAGVITESEVQEIIDHFIMKLRIVKFARTPDYNELFSG
DPTWVTESIGGVGIDGRPLVTKNSFRFLHSLDNLGPAPEPNLTVLWSVRLPDNFKT
YCAKMSIKTSSIQYENDDIMRESYGDDYGIACCVSAMTIGKQMQFFGARANLAKT
LLYAINGGKDEKSGAQVGPNFEGINSEVLEYDEVFKKFDQMMDWLAGVYINSLN
VIHYMHDKYSYERIEMALHDTEIVRTMATGIAGLSVAADSLSAIKYAQVKPIRNEE
GLVVDFEIEGDFPKYGNNDDRVDDIAVDLVERFMTKLRSHKTYRDSEHTMSVLTI
TSNVVYGKKTGNTPDGRKAGEPFAPGANPMHGRDQKGALSSLSSVAKIPYDCCK
DGISNTFSIVPKSLGKEPEDQNRNLTSMLDGYAMQCGHHLNINVFNRETLIDAME
HPEEYPQLTIRVSGYAVNFIKLTREQQLDVISRTFHESM
(SEQ ID NO:358)

Figure 13

MLETNKNHATAWQGFKNGRWNRHVDVREFIQLNYTLYEGNDSFLAGPTEATSK
LWEQVMQLSKEERERGGMWDMDTKVASTITSHDAGYLDKDLETIVGVQTEKPF
KRSMQPFGGIRMAKAACEAYGYELDEETEKIFTDYRKTHNQGVFDAYSREMLNC
RKAGVITGLPDAYGRGRIIGDYRRVALYGVDFLMEEKMHDFNTMSTEMSEDVIR
LREELSEQYRALKELKELGQKYGFDLSRPAENFKEAVQWLYLAYLAAIKEQNGA
AMSLGRTSTFLDIYAERDLKAGVITESEVQEIIDHFIMKLRIVKFARTPDYNELFSG
DPTWVTESIGGVGIDGRPLVTKNSFRFLHSLDNLGPAPEPNLTVLWSVRLPDNFKT
YCAKMSIKTSSIQYENDDIMRESYGDDYGIACCVSAMTIGKQMQFFGARANLAKT
LLYAINGGKDEKSGAQVGPNFEGINSEVLEYDEVFKKFDQMMDWLAGVYINSLN
VIHYMHDKYSYERIEMALHDTEIVRTMATGIAGLSVAADSLSAIKYAQVKPIRNEE
GLVVDFEIEGDFPKYGNNDDRVDDIAVDLVERFMTKLRSHKTYRDSEHTMSVLTI
TSNVVYGKKTGNTPDGRKAGEPFAPGANPMHGRDQKGALSSLSSVAKIPYDCCK
DGISNTFSIVPKSLGKEPEDQNRNLTSMLDGYAMQCGHHLNINVFNRETLIDAME
HPEEYPQLTIRVSGYAVNFIKLTREQQLDVISRTFHESM
(SEQ ID NO:359)

Figure 14

MLETNKNHATAWQGFKNGRWNRHVDVREFIQLNYTLYEGNDSFLAGPTEATSK
LWEQVMQLSKEERERGGMWDMDTKVASTITSHDAGYLDKDLETIVGVQTEKPF
KRSMQPFGGIRMAKAACEAYGYELDEETEKIFTDYRKTHNQGVFDAYSREMLNC
RKAGVITGLPDAYGRGRIIGDYRRVALYGVDFLMEEKMHDFNTMSTEMSEDVIR
LREELSEQYRALKELKELGQKYGFDLSRPAENFKEAVQWLYLAYLAAIKEQNGA
AMSLGRTSTFLDIYAERDLKAGVITESEVQEIIDHFIMKLRIVKFARTPDYNELFSG
DPTWVTESIGGVGIDGRPLVTKNSFRFLHSLDNLGPAPEPNLTVLWSVRLPDNFKT
YCAKMSIKTSSIQYENDDIMRESYGDDYGIACCVSAMTIGKQMQFFGARANLAKT
LLYAINGGKDEKSGAQVGPNFEGINSEVLEYDEVFKKFDQMMDWLAGVYINSLN
VIHYMHDKYSYERIEMALHDTEIVRTMATGIAGLSVAADSLSAIKYAQVKPIRNEE
GLVVDFEIEGDFPKYGNNDDRVDDIAVDLVERFMTKLRSHKTYRDSEHTMSVLTI
TSNVVYGKKTGNTPDGRKAGEPFAPGANPMHGRDQKGALSSLSSVAKIPYDCCK
DGISNTFSIVPKSLGKEPEDQNRNLTSMLDGYAMQCGHHLNINVFNRETLIDAME
HPEEYPQLTIRVSGYAVNFIKLTREQQLDVISRTFHESM
(SEQ ID NO:360)

Figure 15
MLETNKNHATAWQGFKNGRWNRHVDVREFIQLNYTLYEGNDSFLAGPTEATSK
LWEQVMQLSKEERERGGMWDMDTKVASTITSHDAGYLDKDLETIVGVQTEKPF
KRSMQPFGGIRMAKAACEAYGYELDEETEKIFTDYRKTHNQGVFDAYSREMLNC
RKAGVITGLPDAYGRGRIIGDYRRVALYGVDFLMEEKMHDFNTMSTEMSEDVIR
LREELSEQYRALKELKELGQKYGFDLSRPAENFKEAVQWLYLAYLAAIKEQNGA
AMSLGRTSTFLDIYAERDLKAGVITESEVQEIIDHFIMKLRIVKFARTPDYNELFSG
DPTWVTESIGGVGIDGRPLVTKNSFRFLHSLDNLGPAPEPNLTVLWSVRLPDNFKT
YCAKMSIKTSSIQYENDDIMRESYGDDYGIACCVSAMTIGKQMQFFGARANLAKT
LLYAINGGKDEKSGAQVGPNFEGINSEVLEYDEVFKKFDQMMDWLAGVYINSLN
VIHYMHDKYSYERIEMALHDTEIVRTMATGIAGLSVAADSLSAIKYAQVKPIRNEE
GLVVDFEIEGDFPKYGNNDDRVDDIAVDLVERFMTKLRSHKTYRDSEHTMSVLTI
TSNVVYGKKTGNTPDGRKAGEPFAPGANP
MHGRDQKGALSSLSSVAKIPYDCCKDGISNTFSIVPKSLGKEPEDQNRNLTSMLDG
YAMQCGHHLNINVFNRETLIDAMEHPEEYPQLTIRVSGYAVNFIKLTREQQLDVIS
RTFHESM
(SEQ ID NO:361)

Figure 16
MLETNKNHATAWQGFKNGRWNRHVDVREFIQLNYTLYEGNDSFLAGPTEATSK
LWEQVMQLSKEERERGGMWDMDTKVASTITSHDAGYLDKDLETIVGVQTEKPF
KRSMQPFGGIRMAKAACEAYGYELDEETEKIFTDYRKTHNQGVFDAYSREMLNC
RKAGVITGLPDAYGRGRIIGDYRRVALYGVDFLMEEKMHDFNTMSTEMSEDVIR
LREELSEQYRALKELKELGQKYGFDLSRPAENFKEAVQWLYLAYLAAIKEQNGA
AMSLGRTSTFLDIYAERDLKAGVITESEVQEIIDHFIMKLRIVKFARTPDYNELFSG
DPTWVTESIGGVGIDGRPLVTKNSFRFLHSLDNLGPAPEPNLTVLWSVRLPDNFKT
YCAKMSIKTSSIQYENDDIMRESYGDDYGIACCVSAMTIGKQMQFFGARANLAKT
LLYAINGGKDEKSGAQVGPNFEGINSEVLEYDEVFKKFDQMMDWLAGVYINSLN
VIHYMHDKYSYERIEMALHDTEIVRTMATGIAGLSVAADSLSAIKYAQVKPIRNEE
GLVVDFEIEGDFPKYGNNDDRVDDIAVDLVERFMTKLRSHKTYRDSEHTMSVLTI
TSNVVYGKKTGNTPDGRKAGEPFAPGANPMHGRDQKGALSSLSSVAKIPYDCCK
DGISNTFSIVPKSLGKEPEDQNRNLTSMLDGYAMQCGHHLNINVFNRETLIDAME
HPEEYPQLTIRVSGYAVNFIKLTREQQLDVISRTFHESM
(SEQ ID NO:362)

Figure 17

MLETNKNHATAWQGFKNGRWNRHVDVREFIQLNYTLYEGNDSFLAGPTEATSK
LWEQVMQLSKEERERGGMWDMDTKVASTITSHDAGYLDKDLETIVGVQTEKPF
KRSMQPFGGIRMAKAACEAYGYELDEETEKIFTDYRKTHNQGVFDAYSREMLNC
RKAGVITGLPDAYGRGRIIGDYRRVALYGVDFLMEEKMHDFNTMSTEMSEDVIR
LREELSEQYRALKELKELGQKYGFDLSRPAENFKEAVQWLYLAYLAAIKEQNGA
AMSLGRTSTFLDIYAERDLKAGVITESEVQEIIDHFIMKLRIVKFARTPDYNELFSG
DPTWVTESIGGVGIDGRPLVTKNSFRFLHSLDNLGPAPEPNLTVLWSVRLPDNFKT
YCAKMSIKTSSIQYENDDIMRESYGDDYGIACCVSAMTIGKQMQFFGARANLAKT
LLYAINGGKDEKSGAQVGPNFEGINSEVLEYDEVFKKFDQMMDWLAGVYINSLN
VIHYMHDKYSYERIEMALHDTEIVRTMATGIAGLSVAADSLSAIKYAQVKPIRNEE
GLVVDFEIEGDFPKYGNNDDRVDDIAVDLVERFMTKLRSHKTYRDSEHTMSVLTI
TSNVVYGKKTGNTPDGRKAGEPFAPGANPMHGRDQKGALSSLSSVAKIPYDCCK
DGISNTFSIVPKSLGKEPEDQNRNLTSMLDGYAMQCGHHLNINVFNRETLIDAME
HPEEYPQLTIRVSGYAVNFIKLTREQQLDVISRTFHESM
(SEQ ID NO:363)

Figure 18

KKENKQLTYTTVKDIGDMNPHVYGGSMSAESMIYEPLVRNTKDGIKPLLAKKWG
VSEDGKTYTFHLRDDVKFHDGTPFDADAVKKNIDAVQENKKLHSWLKISTLIDN
VKVKDKYTVELNLKEAYQPALAELAMPRPYVFVSPKDFKNGTTKDGVKKFDGT
GPFKLGEHKKDESADFNKNDQYWGEKSKLNKVQAKVMPAGETAFLSMKKGETN
FAFTDDGGTDSLDKDSLKQLKDTGDYQVKRSQPMNTKMLVVNSGKKDNAVSDK
TVRQAIGHMVNRDKIAKEILDGQEKPATQLFAKNVTDINFDMPTRKYDLKKAESL
LDEAGWKKGKDSDVRQKDGKNLEMAMYYDKGSSSQKEQAEYLQAEFKKMGIK
LNINGETSDKIAERRTSGDYDLMFNQTWGLLYDPQSTIAAFKAKNGMKVQHQAL
RIKIKYTTALMTHLKSKTVKSVQTLIKTFNKLMMKVSLSLFHTVVQLLRRKIKKY
HSHNHSTNYHSMKCSIN
(SEQ ID NO:364)

Figure 19

MRKLTKMSAMLLASGLILTGCGGNKGLEEKKENKQLTYTTVKDIGDMNPHVYG
GSMSAESMIYEPLVRNTKDGIKPLLAKKWDVSEDGKTYTFHLRDDVKFHDGTPF
DADAVKKNIDAVQENKKLHSWLKISTLIDNVKVKDKYTVELNLKEAYQPALAEL
AMPRPYVFVSPKDFKNGTTKDGVKKFDGTGPFKLGEHKKDESADFNKNDQYWG
EKSKLNKVQAKVMPAGETAFLSMKKGETNFAFTDDRGTDSLDKDSLKQLKDTG
DYQVKRSQPMNTKMLVVNSGKKDSAVSDKTVRQAIGHMVNRDKIAKEILDGQE
KPATQLFAKNVTDINFDMPTRKYDLKKAESLLDEAGWKKGKDSDVRQKDGKNL
EMAMYYDKGSSSQKEQAEYLQAEFKKMGIKLNINGETSDKIAERRTSGDYDLMF
NQTWGLLYDPQSTIAAFKAKNGYESATSGIENKDKIYNSIDDAFKIQNGKERSDA
YKNILKQVNDEGIFIPISHGSMTVVAPKDLEKVSFTQSQYELPFNEMQYK
(SEQ ID NO:365)

Figure 20

MRKLTKMSAMLLASGLILTGCGGNKGLEEKKENKQLTYTTVKDIGDMNPHVYG
GSMSAESMIYEPLVRNTKDGIKPLLAKKWDVSEDGKTYTFHLRDDVKFHDGTTF
DADAVKKNIDAVQQNKKLHSWLKISTLIDNVKVKDKYTVELNLKEAYQPALAEL
AMPRPYVFVSPKDFKNGTTKDGVKKFDGTGPFKLGEHKKDESADFNKNDQYWG
EKSKLNKVQAKVMPAGETAFLSMKKGETNFAFTDDRGTDSLDKDSLKQLKDTG
DYQVKRSQPMNTKMLVVNSGKKDNAVSDKTVRQAIGHMVNRDKIAKEILDGQE
KPATQLFAKNVTDINFDMPTRKYDLKKAESLLDEAGWKKGKDSDVRQKDGKNL
EMAMYYDKGSSSQKEQAEYLQAEFKKMGIKLNINGETSDKIAERRTSGDYDLMF
NQTWGLLYDPQSTIAAFKAKNGYESATSGIENKDKIYNSIDDAFKIQNGKERSDA
YKNILKQIDDEGIFIPISHGSMTVVAPKDLEKVSFTQSQYELPFNEMQYK
(SEQ ID NO:366)

Figure 21

MRKLTKMSAMLLASGLILTGCGGNKGLEEKKENKQLTYTTVKDIGDMNPHVYG
GSMSAESMIYEPLVRNTKDGIKPLLAKKWDVSEDGKTYTFHLRDDVKFHDGTPF
DADAVKKNIDAVQENKKLHSWLKISTLIDNVKVKDKYTVELNLKEAYQPALAEL
AMPRPYVFVSPKDFKNGTTKDGVKKFDGTGPFKLGEHKKDESADFNKNDQYWG
EKSKLNKVQAKVMPAGETAFLSMKKGETNFAFTDDRGTDSLDKDSLKQLKDTG
DYQVKRSQPMNTKMLVVNSGKKDNAVSDKTVRQAIGHMVNRDKIAKEILDGQE
KPATQLFAKNVTDINFDMPTRKYDLKKAESLLDEAGWKKGKDSDVRQKDGKNL
EMAMYYDKGSSSQKEQAEYLQAEFKKMGIKLNINGETSDKIAERRTSGDYDLMF
NQTWGLLYDPQSTIAAFKAKNGYESATSGIENKDKIYNSIDDAFKIQNGKERSDA
YKNILKQIDDEGIFIPISHGSMTVVAPKDLEKVAFTQSQYELPFNEMQYK
(SEQ ID NO:367)

Figure 22

MRKLTKMSAMLLASGLILTGCGGNKGLEEKKENKQLTYTTVKDIGDMNPHVYG
GSMSAESMIYEPLVRNTKDGIKPLLAKKWDVSEDGKTYTFHLRDDVKFHDGTPF
DADAVKKNIDAVQQNKKLHSWLKISTLIDNVKVKDKYTVELNLKEAYQPALAEL
AMPRPYVFVSPKDFKNGTTKDGVKKFDGTGPFKLGEHKKDESADFNKNDQYWG
EKSKLNKVQAKVMPAGETAFLSMKKGETNFAFTDDRGTDSLDKDSLKQLKDTG
DYQVKRSQPMNTKMLVVNSGKKDNAVSDKTVRQAIGHMVNRDKIAKEILDGQE
KPATQLFAKNVTDINFDMPTRKYDLKKAESLLDEAGWKKGKDSDVRQKDGKNL
EMAMYYDKGSSSQKEQAEYLQAEFKKMGIKLNINGETSDKIAERRTSGDYDLMF
NQTWGLLYDPQSTIAAFKAKNGYESATSGIENKDKIYNSIDDAFKIQNGKERSGA
YKNILKQIDDEGIFIPISHGSMTVVAPKDLEKVSFTQSQYELPFNEMQYK
(SEQ ID NO:368)

Figure 23

MRKLTKMSAMLLASGLILTGCGGNKGLEEKKENKQLTYTTVKDIGDMNPHVYG
GSMSAESMIYEPLVRNTKDGIKPLLAKKWDVSEDGKTYTFHLRDDVKFHDGTPF
DADAVKKNIDAVQENKKLHSWLKISTLIDNVKVKDKYTVELNLKEAYQPALAEL
AMPRPYVFVSPKDFKNGTTKDGVKKFDTGPFKLGEHKKDESADFNKNDQYWG
EKSKLNKVQAKVMPAGETAFLSMKKGETNFAFTDDRGTDSLDKDSLKQLKDTG
DYQVKRSQPMNTKMLVVNSGKKDNAVSDKTVRQAIGHMVNRDKIAKEILDGQE
KPATQLFAKNVTDINFDMPTRKYDLKKAESLLDEAGWKKGKDSDVRQKDGKNL
EMAMYYDKGSSSQKEQAEYLQAEFKKMGIKLNINGETSDKIAERRTSGDYDLMF
NQTWGLLYDPQSTIAAFKAKNGYESATSGIENKDKIYNSIDDAFKIQNGKERSDA
YKNILKQIDDEGIFIPISHGSMTVVAPKDLEKVSFTQSQYELPFNEMQYK (SEQ ID NO:369)

Figure 24

MRKLTKMSAMLLASGLILTGCGGNKGLEEKKENKQLTYTTVKDIGDMNPHVYG
GSMSAESMIYEPLVRNTKDGIKPLLAKKWDVSEDGKTYTFHLRDDVKFHDGTTF
DADAVKKNIDAVQQNKKLHSWLKISTLIDNVKVKDKYTVELNLKEAYQPALAEL
AMPRPYVFVSPKDFKNGTTKDGVKKFDTGPFKLGEHKKDESADFNKNDQYWG
EKSKLNKVQAKVMPAGETAFLSMKKGETNFAFTDDRGTDSLDKDSLKQLKDTG
DYQVKRSQPMNTKMLVVNSGKKDNAVSDKTVRQAIGHMVNRDKIAKEILDGQE
KPATQLFAKNVTDINFDMPTRKYDLKKAESLLDEAGWKKGKDSDVRQKDGKNL
EMAMYYDKGSSSQKEQAEYLQAEFKKMGIKLNINGETSDKIAERRTSGDYDLMF
NQTWGLLYDPQSTIAAFKAKNGYESATSGIENKDKIYNSIDDAFKIQNGKERSDA
YKNILKQIDDEGIFIPISHGSMTVVAPKDLEKVSFTQSQYELPFNEMQYK (SEQ ID NO:370)

Figure 25

MRKLTKMSAMLLASGLILTGCGGNKGLEEKKENKQLTYTTVKDIGDMNPHVYG
GSMSAESMIYEPLVRNTKDGIKPLLAKKWDVSEDGKTYTFHLRDDVKFHDGTPF
DADAVKKNIDAVQENKKLHSWLKISTLIDNVKVKDKYTVELNLKEAYQPALAEL
AMPRPYVFVSPKDFKNGTTKDGVKKFDTGPFKLGEHKKDESADFNKNDQYWG
EKSKLNKVQAKVMPAGETAFLSMKKGETNFAFTDDRGTDSLDKDSLKQLKDTG
DYQVKRSQPMNTKMLVVNSGKKDNAVSDKTVRQAIGHMVNRDKIAKEILDGQE
KPATQLFAKNVTDINFDMPTRKYDLKKAESLLDEAGWKKGKDSDVRQKDGKNL
EMAMYYDKGSSSQKEQAEYLQAEFKKMGIKLNINGETSDKIAERRTSGDYDLMF
NQTWGLLYDPQSTIAAFKAKNGYESATSGIENKDKIYNSIDDAFKIQNGKERSDA
YKNILKQIDDEGIFIPISHGSMTVVAPKDLEKVSFTQSQYELPFNEMQYK
(SEQ ID NO:371)

Figure 26

MRKLTKMSAMLLTSGLILTGCGGNKGLEEKKENKQLTYTTVKDIGDMNPHVYG
GSMSAESMIYEPLVRNTKDGIKPLLAKKWDVSEDGKTYTFHLRDDVKFHDGTPF
DADAVKKNIDAVQENKKLHSWLKISTLIDNVKVKDKYTVELNLKEAYQPALAEL
AMPRPYVFVSPKDFKNGTTKDGVKKFDTGPFKLGEHKKDESADFNKNDQYWG
EKSKLNKVQAKVMPAGETAFLSMKKGETNFAFTDDRGTDSLDKDSLKQLKDTG
DYQVKRSQPMNTKMLVVNSGKKDNAVSDKTVRQAIGHMVNRDKIAKEILDGQE
KPATQLFAKNVTDINFDMPTRKYDLKKAESLLDEAGWKKGKDSDVRQKDGKNL
EMAMYYDKGSSSQKEQAEYLQAEFKKMGIKLNINGETSDKIAERRTSGDYDLMF
NQTWGLLYDPQSTIAAFKAKNGYESATSGIENKDKIYNSIDDAFKIQNGKERSDA
YKNILKQIDDEGIFIPISHGSMTVVAPKDLEKVSFTQSQYELPFNEMQYK
(SEQ ID NO:372)

Figure 27

MRKLTKMSAMLLASGLILTGCGGNKGLEEKKENKQLTYTTVKDIGDMNPHVYG
GSMSAESMIYEPLVRNTKDGIKPLLAKKWDVSEDGKTYTFHLRDDVKFHDGTPF
DADAVKKNIDAVQENKKLHSWLKISTLIDNVKVKDKYTVELNLKEAYQPALAEL
AMPRPYVFVSPKDFKNGTTKDGVKKFDGTGPFKLGEHKKDESADFNKNDQYWG
EKSKLNKVQAKVMPAGETAFLSMKKGETNFAFTDDRGTDSLDKDSLKQLKDTG
DYQVKRSQPMNTKMLVVNSGKKDNAVSDKTVRQAIGHMVNRDKIAKEILDGQE
KPATQLFAKNVTDINFDMPTRKYDLKKAESLLDEAGWKKGKDSDVRQKDGKNL
EMAMYYDKGSSSQKEQAEYLQAEFKKMGIKLNINGETSDKIAERRTSGDYDLMF
NQTWGLLYDPQSTIAAFKEKNGYESATSGIENKDKIYNSIDDAFKIQNGKERSDAY
KNILKQIDDEGIFIPISHGSMTVVAPKDLEKVSFTQSQYELPFNEMQYK
(SEQ ID NO:373)

Figure 28

MRKLTKMSAMLLASGLILTGCGGNKGLEEKKENKQLTYTTVKDIGDMNPHVYG
GSMSAESMIYEPLVRNTKDGIKPLLAKKWDVSEDGKTYTFHLRDDVKFHDGTPF
DADAVKKNIDAVQQNKKLHSWLKISTLIDNVKVKDKYTVELNLKEAYQPALAEL
AMPRPYVFVSPKDFKNGTTKDGVKKFDGTGPFKLGEHKKDESADFNKNDQYWG
EKSKLNKVQAKVMPAGETAFLSMKKGETNFAFTDDRGTDSLDKDSLKQLKDTG
DYQVKRSQPMNTKMLVVNSGKKDNAVSDKTVRQAIGHMVNRDKIAKEILDGQE
KPATQLFAKNVTDINFDMPTRKYDLKKAESLLDEAGWKKGKDSDVRQKDGKNL
EMAMYYDKGSSSQKEQAEYLQAEFKKMGIKLNINGETSDKIAERRTSGDYDLMF
NQTWGLLYDPQSTIAAFKAKNGYESATSGIENKDKIYNSIDDAFKIQNGKERSGA
YKNILKQIDDEGIFIPISHGSMTVVAPKDLEKVSFTQSQYELPFNEMQYK
(SEQ ID NO:374)

Figure 29

SSDSKDKETTSIKHAMGTTEIKGKPKRVVTLYQGATDVAVSLGVKPVGAVESWT
QKPKFEYIKNDLKDTKIVGQEPAPNLEEISKLKPDLIVASKVRNEKVYDQLSKIAPT
VSTDTVFKFKDTTKLMGKALGKEKEAEDLLKKYDDKVAAFQKDAKAKYKDAW
PLKASVVNFRADHTRIYAGGYAGEILNDLGFKRNKDLQKQVDNGKDIIQLTSKESI
PLMNADHIFVVKSDPNAKDAALVKKTESEWTSSKEWKNLDAVKNNQVSDDLDEI
TWNLAGGYKSSLKLIDDLYEKLNIEKQSK
(SEQ ID NO:375)

Figure 30

MNKVIKMLVVTLAFLLVLAGCSGNSNKQSSDNKDKETTSIKHAMGTTEIKGKPK
RVVTLYQGATDVAVSLGVKPVGAVESWTQKPKFEYIKNDLKDTKIVGQEPAPNL
EEISKLKPDLIVASKVRNEKVYDQLSKIAPTVSTDTVFKFKDTTKLMGKALGKEKE
AEDLLKKYDDKVAAFQKDAKAKYKDAWPLKASVVNFRADHTRIYAGGYAGEIL
NDLGFKRNKDLQKQVDNGKDIIQLTSKESIPLMNADHIFVVKSDPNAKDAALVKK
TESEWTSSKEWKNLDAVKNNQVSDDLDEITWNLAGGYKSSLKLIDDLYEKLNIE
KQSK
(SEQ ID NO:376)

Figure 31

MNKVIKMLVVTLAFLLVLAGCSGNSNKQSSDNKDKETTSIKHAMGTTEIKGKPK
RVVTLYQGATDVAVSLGVKPVGAVESWTQKPKFEYIKNDLKDTKIVGQEPAPNL
EEISKLKPDLIVASKVRNEKVYDQLSKIAPTVSTDTVFKFKDTTKLMGKALGKEKE
AEDLLKKYDDKVAAFQKDAKAKYKDAWPLKASVVNFRADHTRIYAGGYAGEIL
NDLGFKRNKDLQKQVDNGKDIIQLTSKESIPLMNADHIFVVKSDPNAKDAALVKK
TESEWTSSKEWKNLDAVKNNQVSDDLDEITWNLAGGYKSSLKLIDDLYEKLNIE
KQSK
(SEQ ID NO:377)

Figure 32

MNKVIKMLVVTLAFLLVLAGCSGNSNKQSSDSKDKETTSIKHAMGTTEIKGKPKR
VVTLYQGATDVAVSLGVKPVGAVESWTQKPKFEYIKNDLKDTKIVGQEPAPNLE
EISKLKPDLIVASKVRNEKVYDQLSKIAPTVSTDTVFKFKDTTKLMGKALGKEKE
AEDLLKKYDDKVAAFQKDAKAKYKDAWPLKASVVNFRADHTRIYAGGYAGEIL
NDLGFKRNKDLQKQVDNGKDIIQLTSKESIPLMNADHIFVVKSDPNAKDAALVKK
TESEWTSSKEWKNLDAVKNNQVSDDLDEITWNLAGGYKSSLKLIDDLYEKLNIE
KQSK
(SEQ ID NO:378)

Figure 33

MNKVIKMLVVTLAFLLVLAGCSGNSNKQSSDNKDKETTSIKHAMGTTEIKGKPK
RVVTLYQGATDVAVSLGVKPVGAVESWTQKPKFEYIKNDLKDTKIVGQEPAPNL
EEISKLKPDLIVASKVRNEKVYDQLSKIAPTVSTDTVFKFKDTTKLMGKALGKEKE
AEDLLKKYDDKVAAFQKDAKAKYKDAWPLKASVVNFRADHTRIYAGGYAGEIL
NDLGFKRNKDLQKQVDNGKDIIQLTSKESIPLMNADHIFVVKSDPNAKDAALVKK
TESEWTSSKEWKNLDAVKNNQVSDDLDEITWNLAGGYKSSLKLIDDLYEKLNIE
KQSK
(SEQ ID NO:379)

Figure 34

MNKVIKMLVVTLAFLLVLAGCSGNSNKQSSDNKDKETTSIKHAMGTTEIKGKPK
RVVTLYQGATDVAVSLGVKPVGAVESWTQKPKFEYIKNDLKDTKIVGQEPAPNL
EEISKLKPDLIVASKVRNEKVYDQLSKIAPTVSTDTVFKFKDTTKLMGKALGKEKE
AEDLLKKYDDKVAAFQKDAKAKYKDAWPLKASVVNFRADHTRIYAGGYAGEIL
NDLGFKRNKDLQKQVDNGKDIIQLTSKESIPLMNADHIFVVKSDPNAKDAALVKK
TESEWTSSKEWKNLDAVKNNQVSDDLDEITWNLAGGYKSSLKLIDDLYEKLNIE
KQSK
(SEQ ID NO:380)

Figure 35

MNKVIKMLVVTLAFLLVLAGCSGNSNKQSSDNKDKETTSIKHAMGTTEIKGKPK
RVVTLYQGATDVAVSLGVKPVGAVESWTQKPKFEYIKNDLKDTKIVGQEPAPNL
EEISKLKPDLIVASKVRNEKVYDQLSKIAPTVSTDTVFKFKDTTKLMGKALGKEKE
AEDLLKKYDDKVAAFQKDAKAKYKDAWPLKASVVNFRADHTRIYAGGYAGEIL
NDLGFKRNKDLQKQVDNGKDIIQLTSKESIPLMNADHIFVVKSDPNAKDAALVKK
TESEWTSSKEWKNLDAVKNNQVSDDLDEITWNLAGGYKSSLKLIDDLYEKLNIE
KQSK
(SEQ ID NO:381)

Figure 36

MNKVIKMLVVTLAFLLVLAGCSGNSNKQSSDNKDKETTSIKHAMGTTEIKGKPK
RVVTLYQGATDVAVSLGVKPVGAVESWTQKPKFEYIKNDLKDTKIVGQEPAPNL
EEISKLKPDLIVASKVRNEKVYDQLSKIAPTVSTDTVFKFKDTTKLMGKALGKEKE
AEDLLKKYDDKVAAFQKDAKAKYKDAWPLKASVVNFRADHTRIYAGGYAGEIL
NDLGFKRNKDLQKQVDNGKDIIQLTSKESIPLMNADHIFVVKSDPNAKDAALVKK
TESEWTSSKEWKNLDAVKNNQVSDDLDEITWNLAGGYKSSLKLIDDLYEKLNIE
KQSK
(SEQ ID NO:382)

Figure 37

MNKVIKMLVVTLAFLLVLAGCSGNSNKQSSDNKDKETTSIKHAMGTTEIKGKPK
RVVTLYQGATDVAVSLGVKPVGAVESWTQKPKFEYIKNDLKDTKIVGQEPAPNL
EEISKLKPDLIVASKVRNEKVYDQLSKIAPTVSTDTVFKFKDTTKLMGKALGKEKE
AEDLLKKYDDKVAAFQKDAKAKYKDAWPLKASVVNFRADHTRIYAGGYAGEIL
NDLGFKRNKDLQKQVDNGKDIIQLTSKESIPLMNADHIFVVKSDPNAKDAALVKK
TESEWTSSKEWKNLDAVKNNQVSDDLDEITWNLAGGYKSSLKLIDDLYEKLNIE
KQSK
(SEQ ID NO:383)

Figure 38

MNKVIKMLVVTLAFLLVLAGCSGNSNKQSSDNKDKETTSIKHAMGTTEIKGKPK
RVVTLYQGATDVAVSLGVKPVGAVESWTQKPKFEYIKNDLKDTKIVGQEPAPNL
EEISKLKPDLIVASKVRNEKVYDQLSKIAPTVSTDTVFKFKDTTKLMGKALGKEKE
AEDLLKKYDDKVAAFQKDAKAKYKDAWPLKASVVNFRADHTRIYAGGYAGEIL
NDLGFKRNKDLQKQVDNGKDIIQLTSKESIPLMNADHIFVVKSDPNAKDAALVKK
TESEWTSSKEWKNLDAVKNNQVSDDLDEITWNLAGGYKSSLKLIDDLYEKLNIE
KQSK
(SEQ ID NO:384)

Figure 39

MNKVIKMLVVTLAFLLVLAGCSGNSNKQSSDNKDKETTSIKHAMGTTEIKGKPK
RVVTLYQGATDVAVSLGVKPVGAVESWTQKPKFEYIKNDLKDTKIVGQEPAPNL
EEISKLKPDLIVASKVRNEKVYDQLSKIAPTVSTDTVFKFKDTTKLMGKALGKEKE
AEDLLKKYDDKVAAFQKDAKAKYKDAWPLKASVVNFRADHTRIYAGGYAGEIL
NDLGFKRNKDLQKQVDNGKDIIQLTSKESIPLMNADHIFVVKSDPNAKDAALVKK
TESEWTSSKEWKNLDAVKNNQVSDDLDEITWNLAGGYKSSLKLIDDLYEKLNIE
KQSK
(SEQ ID NO:385)

Figure 40

KESSTKDTISVKDENGTVKVPKDAKRIVVLEYSFADALAALDVKPVGIADDGKKK
RIIKPVREKIGDYTSVGTRKQPNLEEISKLKPDLIIADSSRHKGINKELNKIAPTLSLK
SFDGDYKQNINSFKTIAKALNKEKEGEKRLAEHDKLIKKYKDEIKFDRNQKVLPA
VVAKAGLLAHPNYSYVGQFLNELGFKNALSDDVTKGLSKYLKGPYLQLDTEHLA
DLNPERMIIMTDNAKKDSAEFKKLQEDPTWKKLNAVKNNRVDIVDRDVWARSR
GLISSEEMAKELVELSKKEQK
(SEQ ID NO:386)

Figure 41

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTYGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:387)

Figure 42

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTYGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:388)

Figure 43

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDIEKVAKEKPDLIV
YSTDKDIKKYQKVAPTVVVDYNKHKYLEQQEMLGKIVGKEDKVKAWKKDWEE
TTAKDGKEIKKAIGQDATVSLFDEFDKKLYTYGDNWGRGGEVLYQAFGLKMQPE
QQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:389)

Figure 44

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTYGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:390)

Figure 45

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTYGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:391)

Figure 46

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTYGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:392)

Figure 47

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTYGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:393)

Figure 48

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTYGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:394)

Figure 49

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTYGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:395)

Figure 50

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTYGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK (SEQ ID NO:396)

Figure 51

TEEKTEMTTIKDELGTEKIKKNPKRVVVLEYSFADYLAALDMKPVGIADDGSSKN
ITKSVRDKIGAYESVGSRSQPNMEVISKLKPDLIIADVSRHKKIKSELSKIAPTIMLV
SGTGDYNANIEAFKTVAKAVGREKEGEKRLEKHDKILAEIRKKIEQSTLKSAFALG
ISRAGMFINNEDTFMGQFLIKMGIQPEVTKDKTAHVGERKGGPYIYLNNEELANIN
PKVMILATDGKTDKNRTKFIDPAVWKSLKAVKDNKVYDVDRNKWLKSRGIIASE
SMAEDLEKIAEKAK (SEQ ID NO:397)

Figure 52

MEVISKLKPDLIIADVNRHKKIKSELSKIAPTIMLVSGTGDYNANIEAFKTVAKAV
GKEKEGEKRLEKHDKILAEIRKKIEQSTLKSAFAFGISRAGMFINNEDTFMGQFLIK
MGIQPEVTKDKTMHVGERKGGPYIYLNNEELANINPKVMILATDGKTDKNRTKFI
DPAVWKSLKAVKDNKVYDVDRNKWLKSRGIIASESMAEDLEKIAEKAK (SEQ ID NO:398)

Figure 53

MNRNIVKLVVFMLILVVAVAGCGQKDTEEKTEMTTIKDELGTEKIKKNPKRVVV
LEYSFADYLAALDMKPVGIADDGSTKNITKSVRDKIGAYESVGSRPQPNMEVISK
LKPDLIIADVSRHKKIKSELSKIAPTIMLVSGTGDYNANIEAFKTVAKAVGKEKEG
EKRLEKHDKILAEIRKKIEQSTLKSAFAFGISRAGMFINNEDTFMGQFLIKMGIQPE
VTKDKTTHVGERKGGPYIYLNNEELANINPKVMILATDGKTDKNRTKFIDPAVW
KSLKAVKDNKVYDVDRNKWLKSRGIIASESMAEDLEKIAEKAK (SEQ ID NO:399)

Figure 54

MNRNIVKLVVFMLILVVAVAGCGQKDTEEKTEMTTIKDELGTEKIKKNPKRIVVL
EYSFADYLAALDMKPVGIADDGSTKNITKSVRDKIGAYESVGSRPQPNMEVISKL
KPDLIIADVSRHKKIKSELSKIAPTIMLVSGTGDYNANIEAFKTVAKAVGKEKEGE
KRLEKHNKILAEIRKKIEQSTLKSAFAFGISRAGMFINNEDTFMGQFLIKMGIQPEV
TKDKTAHVGERKGGPYIYLNNEELANINPKVMILATNGKTDKNRTKFIDPAVWKS
LKAVKDNKVYDVDRNKWLQSRGIMASESMAEDLEKIAEKAK (SEQ ID NO:400)

Figure 55

MNRNIVKLVVFMLILVVAVAGCGQKDTEEKTEMTTIKDELGTEKIKKNPKRVVV
LEYSFADYLAALDMKPVGIADDGSSKNITKSVRDKIGAYESVGSRPQPNMEVISKL
KPDLIIADVSRHKKIKSELSKIAPTIMLVSGTGDYNANIEAFKTVAKAVGKEKEGE
KRLEKHDKILAEIRKKIEQSTLKSAFAFGISRAGMFINNEDTFMGQFLLKMGIQPEV
TKDKTTHVGERKGGPYIYLNNEELANINPKVMILATDGKTDKNRTKFIDPAVWKS
LKAVKDNKVYDVDRNKWLKSRGIIASESMAEDLEKIAEKAK (SEQ ID NO:401)

Figure 56

MNRNIVKLVVFMLILVVAVAGCGQKDTEEKTEMTTIKDELGTEKIKKNPKRVVV
LEYSFADYLAALDMKPVGIADDGSTKNITKSVRDKIGAYESVGSRPQPNMEVISK
LKPDLIIADVSRHKKIKSELSKIAPTIMLVSGTGDYNANIEAFKTVAKAVGKEKEG
EKRLEKHDKILAEIRKKIEQSTLKSAFAFGISRAGMFINNEDTFMGQFLIKMGIQPE
VTKDKTTHVGERKGGPYIYLNNEELANINPKVMILATDGKTDKNRTKFIDPAVW
KSLKAVKDNKVYDVDRNKWLKSRGIIASESMAEDLEKIAEKAK (SEQ ID NO:402)

Figure 57

MNRNIVKLVVFMLILVVAVAGCGQKDTEEKTEMTTIKDELGTEKIKKNPKRVVV
LEYSFADYLAALDMKPVGIADDGSTKNITKSVRDKIGAYESVGSRPQPNMEVISK
LKPDLIIADVSRHKKIKSELSKIAPTIMLVSGTGDYNANIEAFKTVAKAVGKEKEG
EKRLEKHDKILAEIRKKIEQSTLKSAFAFGISRAGMFINNEDTFMGQFLIKMGIQPE
VTKDKTTHVGERKGGPYIYLNNEELANINPKVMILATDGKTDKNRTKFIDPAVW
KSLKAVKDNKVYDVDRNKWLKSRGIIASESMAEDLEKIAEKAK
(SEQ ID NO:403)

Figure 58

MTTIKDELGTEKIKKNPKRVVVLEYSFADYLAALDMKPVGIADDGSTKNITKSVR
DKIGAYESVGSRPQPNMEVISKLKPDLIIADVSRHKKIKSELSKIAPTIMLVSGTGD
YNANIEAFKTVAKAVGKEKEGEKRLEKHDKILAEIRKKIEQSTLKSAFAFGISRAG
MFINNEDTFMGQFLIKMGIQPEVTKDKTTHVGERKGGPYIYLNNEELANINPKVMI
LATDGKTDKNRTKFIDPAVWKSLKAVKDNKVYDVDRNKWLKSRGIIASESMAED
LEKIAEKAK
(SEQ ID NO:404)

Figure 59

MNRNIVKLVVFMLILVVAVAGCGQKDTEEKTEMTTIKDELGTEKIKKNPKRVVV
LEYSFADYLAALDMKPVGIADDGSTKNITKSVRDKIGAYESVGSRPQPNMEVISK
LKPDLIIADVSRHKKIKSELSKIAPTIMLVSGTGDYNANIEAFKTVAKAVGKEKEG
EKRLEKHDKILAEIRKKIEQSTLKSAFAFGISRAGMFINNEDTFMGQFLIKMGIQPE
VTKDKTTHVGERKGGPYIYLNNEELANINPKVMILATDGKTDKNRTKFIDPAVW
KSLKAVKDNKVYDVDRNKWLKSRGIIASESMAEDLEKIAEKAK
(SEQ ID NO:405)

Figure 60

MTTIKDELGTEKIKKNPKRVVVLEYSFADYLAALDMKPVGIADDGSTKNITKSVR
DKIGAYESVGSRPQPNMEVISKLKPDLIIADVSRHKKIKSELSKIAPTIMLVSGTGD
YNANIEAFKTVAKAVGKEKEGEKRLEKHDKILAEIRKKIEQSTLKSAFAFGISRAG
MFINNEDTFMGQFLIKMGIQPEVTKDKTTHVGERKGGPYIYLNNEELANINPKVMI
LATDGKTDKNRTKFIDPAVWKSLKAVKDNKVYDVDRNKWLKSRGIIASESMAED
LEKIAEKAK (SEQ ID NO:406)

Figure 61

MNRNIVKLVVFMLILVVAVAGCGQKDTEEKTEMTTIKDELGTEKIKKNPKRVVV
LEYSFADYLAALDMKPVGIADDGSSKNITKSVRDKIGAYESVGSRPQPNMEVISKL
KPDLIIADVSRHKKIKSELSKIAPTIMLVSGTGDYNANIEAFKTVAKAVGKEKEGE
KRLEKHDKILAEIRKKIEQSTLKSAFAFGISRAGMFINNEDTFMGQFLLKMGIQPEV
TKDKTTHVGERKGGPYIYLNNEELANINPKVMILATDGKTDKNRTKFIDPAVWKS
LKAVKDNKVYDVDRNKWLKSRGIIASESMAEDLEKIAEKAK (SEQ ID NO:407)

Figure 62

GSDDNGSSKSPYHRIVSLMPSNTEILYELGLGKYIVGVSTVDDYPKDVKKGKKQF
DALNLNKEELLKAKPDLILAHESQKATANKVLSSLEKQGIKVVYVKDAQSIDETY
NTFKQIGKLTHHDKQAEQLVEETKDNIDKVIDSIPAHHKKSKVFIEVSSKPEIYTAG
KHTFFNDMLEKLEAQNVYSDINGWNPVTKESIIKKNPDILISTEAKTRSDYMDIIKK
RGGFNKINAVKNTRIEVVNGDEVSRPGPRIDEGLKELRDAIYRK (SEQ ID NO:408)

Figure 63

MKKSLIAFILIFMLVLSGCGMKDNDKQGSDDNGSSKSPYHRIVSLMPSNTEILYEL
GLGKYIVGVSTVDDYPKDVKKGKKQFDALNLNKEELLKAKPDLILAHESQKATA
NKVLSSLEKQGIKVVYIKDAQSIDETYNTFKQIGKLTHHDKQAEQLVEETKDNIDK
VIDSIPAHHKKSKVFIEVSSKPEIYTAGKHTFFNDMLEKLEAQNVYSDINGWNPVT
KESIIKKNPDILISTEAKTRSDYMDIIKKRGGFNKINAVKNTRIEVVNGDEVSRPGP
RIDEGLKELRDAIYRK (SEQ ID NO:409)

Figure 64

MKKSLIAFILIFMLVLSGCGMKDNDKQGSDDNGSSKSPYHRIVSLMPSNTEILYEL
GLGKYIVGVSTVDDYPKDVKEGKKQFDALNLNKEELLKAKPDLILAHESQKATA
NKVLSSLEKQGIKVVYVKDAQSIDETYNTFKQIGKLTHHDKQAEQLVEETKDNID
KVIDSIPAHHKKSKVFIEVSSKPEIYTAGKHTFFNDMLEKLEAQNVYSDINGWNPV
TKESIIKKNPDILISTEAKTRSDYMDIIKKRGGFNKINAVKNTRIEVVNGDEVSRPGP
RIDEGLKELRDAIYRK (SEQ ID NO:410)

Figure 65

MKKSLIAFILIFMLVLSGCGMKDNDKQGSDDNGSSKSPYHRIVSLMPSNTEILYEL
GLGKYIVGVSTVDDYPKDVKKGKKQFDALNLNKEELLKAKPDLILAHESQKATA
NKVLSSLEKQGIKVVYVKDAQSIDETYNTFKQIGKLTHHEKQAEQLVEETKDNID
KVIDSIPAHHKKSKVFIEVSSKPEIYTAGKHTFFNDMLEKLEAQNVYSDINGWNPV
TKESIIKKNPDILISTEAKTRSDYMDIIKKRGGFNKINAVKNTRIEVVNGDEVSRPGP
RIDEGLKELRDAIYRK (SEQ ID NO:411)

Figure 66

MKKSLIAFILIFMLVLSGCGMKDNDKQGSNDNGSSKSPYHRIVSLMPSNTEILYEL
GLGKYIVGVSTVDDYPKDVKEGKKQFDALNLNKEELLKEKPDLILAHESQKATA
NKVLSSLEKQGIKVVYVKDAQSIDETYNTFKQIGKLTHHDKQAEQLVEETKDNID
KVIDSIPAHHKKSKVFIEVSSKPEIYTAGKHTFFNDMLEKLEAQNVYSDINGWNPV
TKESIIKKNPDILISTEAKTRSDYMDIIKKRGGFNKINAVKNTRIEVVNGDEVSRPGP
RIDEGLKELRDAIYRK (SEQ ID NO:412)

Figure 67

MKKSLIAFILIFMLVLSGCGMKDNDKQGSNDNGSSKSPYHRIVSLMPSNTEILYEL
GLGKYIVGVSTVDDYPKDVKKGKKQFDALNLNKEELLKAKPDLILAHESQKATA
NKVLSSLEKQGIKVVYVKDAQSIDETYNTFKQIGKLTHHDKQAEQLVEETKDNID
KVIDSIPAHHKKSKVFIEVSSKPEIYTAGKHTFFNDMLEKLEAQNVYSDINGWNPV
TKESIIKKNPDILISTEAKTRSDYMDIIKKRGGFNKINAVKNTRIEVVNGDEVSRPGP
RIDEGLKELRDAIYRK (SEQ ID NO:413)

Figure 68

MKKSLIAFILIFMLVLSGCGMKDNDKQGSDDNGSSKSPYHRIVSLMPSNTEILYEL
GLGKYIVGVSTVDDYPKDVKEGKKQFDALNLNKEELLKAKPDLILAHESQKATA
NKVLSSLEKQGIKVVYVKDAQSIDETYNTFKQIGKLTHHDKQAEQLVEETKDNID
KVIDSIPAHHKKSKVFIEVSSKPEIYTAGKHTFFNDMLEKLEAQNVYSDINGWNPV
TKESIIKKNPDILISTEAKTRSDYMDIIKKRGGFNKINAVKNTRIEVVNGDEVSRPGP
RIDEGLKELRDAIYRK (SEQ ID NO:414)

Figure 69

MKDNDKQGSNDNGSSKSPYHRIVSLMPSNTEILYELGLGKYIVGVSTVDDYPKDV
KKGKKQFDALNLNKEELLKAKPDLILAHESQKATANKVLSSLEKQGIKVVYVKD
AQSIDETYNTFKQIGKLTHHDKQAEQLVEETKDNIDKVIDSIPAHHKKSKVFIEVSS
KPEIYTAGKHTFFNDMLEKLEAQNVYSDINGWNPVTKESIIKKNPDILISTEAKTRS
DYMDIIKKRGGFNKINAVKNTRIEVVNGDEVSRPGPRIDEGLKELRDAIYRK (SEQ ID NO:415)

Figure 70

MKKSLIAFILIFMLVLSGCGMKDNDKQGSNDNGSSKSPYHRIVSLMPSNTEILYEL
GLGKYIVGVSTVDDYPKDVKKGKKQFDALNLNKEELLKAKPDLILAHESQKATA
NKVLSSLEKQGIKVVYVKDAQSIDETYNTFKQIGKLTHHDKQAEQLVEETKDNID
KVIDSIPAHHKKSKVFIEVSSKPEIYTAGKHTFFNDMLEKLEAQNVYSDINGWNPV
TKESIIKKNPDILISTEAKTRSDYMDIIKKRGGFNKINAVKNTRIEVVNGDEVSRPGP
RIDEGLKELRDAIYRK (SEQ ID NO:416)

Figure 71

MKDNDKQGSNDNGSSKSPYHRIVSLMPSNTEILYELGLGKYIVGVSTVDDYPKDV
KKGKKQFDALNLNKEELLKAKPDLILAHESQKATANKVLSSLEKQGIKVVYVKD
AQSIDETYNTFKQIGKLTHHDKQAEQLVEETKDNIDKVIDSIPAHHKKSKVFIEVSS
KPEIYTAGKHTFFNDMLEKLEAQNVYSDINGWNPVTKESIIKKNPDILISTEAKTRS
DYMDIIKKRGGFNKINAVKNTRIEVVNGDEVSRPGPRIDEGLKELRDAIYRK
(SEQ ID NO:417)

Figure 72

MKKSLIAFILIFMLVLSGCGMKDNDKQGSNDNGSSKSPYHRIVSLMPSNTEILYEL
GLGKYIVGVSTVDDYPKDVKEGKKQFDALNLNKEELLKEKPDLILAHESQKATA
NKVLSSLEKQGIKVVYVKDAQSIDETYNTFKQIGKLTHHDKQAEQLVEETKDNID
KVIDSIPAHHKKSKVFIEVSSKPEIYTAGKHTFFNDMLEKLEAQNVYSDINGWNPV
TKESIIKKNPDILISTEAKTRSDYMDIIKKRGGFNKINAVKNTRIEVVNGDEVSRPGP
R IDEGLKELRDAIYRK
(SEQ ID NO:418)

Figure 73

SDKSNGKLKVVTTNSILYDMAKNVGGDNVDIHSIVPVGQDPHEYEVKPKDIKKLT
DADVILYNGLNLETGNGWFEKALEQAGKSLKDKKVIAVSKDVKPIYLNGEEGNK
DKQDPHAWLSLDNGIKYVKTIQQTFIDNDKKHKADYEKQGNKYIAQLEKLNNDS
KDKFNDIPKEQRAMITSEGAFKYFSKQYGITPGYIWEINTEKQGTPEQMRQAIEFV
KKHKLKHLLVETSVDKKAMESLSEETKKDIFGEVYTDSIGKEGTKGDSYYKMMK
SNIETVHGSMK
(SEQ ID NO:419)

Figure 74

MKKLVPLLLALLLLVAACGTGGKQSSDKSNGKLKVVTTNSILYDMAKNVGGDN
VDIHSIVPVGQDPHEYEVKPKDIKKLTDADVILYNGLNLETGNGWFEKALEQAGK
SLKDKKVIAVSKDVKPIYLNGEEGNKDKQDPHAWLSLDNGIKYVKTIQQTFIDND
KKHKADYEKQGNKYIAQLEKLNNDSKDKFNDIPKEQRAMITSEGAFKYFSKQYGI
TPGYIWEINTEKQGTPEQMRQAIEFVKKHKLKHLLVETSVDKKAMESLSEETKKD
IFGEVYTDSIGKEGTKGDSYYKMMKSNIETVHGSMK
(SEQ ID NO:420)

Figure 75

MKKLVPLLLALLLLVAACGTGGKQSSDKSNGKLKVVTTNSILYDMAKNVGGDN
VDIHSIVPVGQDPHEYEVKPKDIKKLTDADVILYNGLNLETGNGWFEKALEQAGK
SLKDKKVIAVSKDVKPIYLNGEEGNKDKQDPHAWLSLDNGIKYVKTIQQTFIDND
KKHKADYEKQGNKYIAQLEKLNNDSKDKFNDIPKEQRAMITSEGAFKYFSKQYGI
TPGYIWEINTEKQGTPEQMRQAIEFVKKHKLKHLLVETSVDKKAMESLSEETKKD
IFGEVYTDSIGKEGTKGDSYYKMMKSNIETVHGSMK
(SEQ ID NO:421)

Figure 76

MKKLVPLLLALLLLVAACGTGGKQSSDKSNGKLKVVTTNSILYDMAKNVGGDN
VDIHSIVPVGQDPHEYEVKPKDIKKLTDADVILYNGLNLETGNGWFEKALEQAGK
SLKDKKVIAVSKDVKPIYLNGEEGNKDKQDPHAWLSLDNGIKYVKTIQQTFIDND
KKHKADYEKQGNKYIAQLEKLNNDSKDKFNDIPKEQRAMITSEGAFKYFSKQYGI
TPGYIWEINTEKQGTPEQMRQAIEFVKKHKLKHLLVETSVDKKAMESLSEETKKD
IFGEVYTDSIGKEGTKGDSYYKMMKSNIETVHGSMK
(SEQ ID NO:422)

Figure 77

MKKLVPLLLALLLLVAACGTGGKQSSDKSNGKLKVVTTNSILYDMAKNVGGDN
VDIHSIVPVGQDPHEYEVKPKDIKKLTDADVILYNGLNLETGNGWFEKALEQAGK
SLKDKKVIAVSKDVKPIYLNGEEGNKDKQDPHAWLSLDNGIKYVKTIQQTFIDND
KKHKADYEKQGNKYIAQLEKLNNDSKDKFNDIPKEQRAMITSEGAFKYFSKQYGI
TPGYIWEINTEKQGTPEQMRQAIEFVKKHKLKHLLVETSVDKKAMESLSEETKKD
IFGEVYTDSIGKEGTKGDSYYKMMKSNIETVHGSMK (SEQ ID NO:423)

Figure 78

MKKLVPLLLALLLLVAACGTGGKQSSDKSNGKLKVVTTNSILYDMAKNVGGDN
VDIHSIVPVGQDPHEYEVKPKDIKKLTDADVILYNGLNLETGNGWFEKALEQAGK
SLKDKKVIAVSKDVKPIYLNGEEGNKDKQDPHAWLSLDNGIKYVKTIQQTFIDND
KKHKADYEKQGNKYIAQLEKLNNDSKDKFNDIPKEQRAMITSEGAFKYFSKQYGI
TPGYIWEINTEKQGTPEQMRQAIEFVKKHKLKHLLVETSVDKKAMESLSEETKKD
IFGEVYTDSIGKEGTKGDSYYKMMKSNIETVHGSMK (SEQ ID NO:424)

Figure 79

MKKLVPLLLALLLLVAACGTGGKQSSDKSNGKLKVVTTNSILYDMAKNVGGDN
VDIHSIVPVGQDPHEYEVKPKDIKKLTDADVILYNGLNLETGNGWFEKALEQAGK
SLKDKKVIAVSKDVKPIYLNGEEGNKDKQDPHAWLSLDNGIKYVKTIQQTFIDND
KKHKADYEKQGNKYIAQLEKLNNDSKDKFNDIPKEQRAMITSEGAFKYFSKQYGI
TPGYIWEINTEKQGTPEQMRQAIEFVKKHKLKHLLVETSVDKKAMESLSEETKKD
IFGEVYTDSIGKEGTKGDSYYKMMKSNIETVHGSMK (SEQ ID NO:425)

Figure 80

MKKLVPLLLALLLLVAACGTGGKQSSDKSNGKLKVVTTNSILYDMAKNVGGDN
VDIHSIVPVGQDPHEYEVKPKDIKKLTDADVILYNGLNLETGNGWFEKALEQAGK
SLKDKKVIAVSKDVKPIYLNGEEGNKDKQDPHAWLSLDNGIKYVKTIQQTFIDND
KKHKADYEKQGNKYIAQLEKLNNDSKDKFNDIPKEQRAMITSEGAFKYFSKQYGI
TPGYIWEINTEKQGTPEQMRQAIEFVKKHKLKHLLVETSVDKKAMESLSEETKKD
IFGEVYTDSIGKEGTKGDSYYKMMKSNIETVHGSMK (SEQ ID NO:426)

Figure 81

MKKLVPLLLALLLLVAACGTGGKQSSDKSNGKLKVVTTNSILYDMAKNVGGDN
VDIHSIVPVGQDPHEYEVKPKDIKKLTDADVILYNGLNLETGNGWFEKALEQAGK
SLKDKKVIAVSKDVKPIYLNGEEGNKDKQDPHAWLSLDNGIKYVKTIQQTFIDND
KKHKADYEKQGNKYIAQLEKLNNDSKDKFNDIPKEQRAMITSEGAFKYFSKQYGI
TPGYIWEINTEKQGTPEQMRQAIEFVKKHKLKHLLVETSVDKKAMESLSEETKKD
IFGEVYTDSIGKEGTKGDSYYKMMKSNIETVHGSMK (SEQ ID NO:427)

Figure 82

MKKLVPLLLALLLLVAACGTGGKQSSDKSNGKLKVVTTNSILYDMAKNVGGDN
VDIHSIVPVGQDPHEYEVKPKDIKKLTDADVILYNGLNLETGNGWFEKALEQAGK
SLKDKKVIAVSKDVKPIYLNGEEGNKDKQDPHAWLSLDNGIKYVKTIQQTFIDND
KKHKADYEKQGNKYIAQLEKLNNDSKDSKDKFNDIPKEQRAMITSEGAFKYFSK
QYGITPGYIWEINTEKQGTPEQMRQAIEFVKKHKLKHLLVETSVDKKAMESLSEE
TKKDIFGEVYTDSIGKEGTKGDSYYKMMKSNIETVHGSMK (SEQ ID NO:428)

Figure 83

MKKLVPLLLALLLLVAACGTGGKQSSDKSNGKLKVVTTNSILYDMAKNVGGDN
VDIHSIVPVGQDPHEYEVKPKDIKKLTDADVILYNGLNLETGNGWFEKALEQAGK
SLKDKKVIAVSKDVKPIYLNGEEGNKDKQDPHAWLSLDNGIKYVKTIQQTFIDND
KKHKADYEKQGNKYIAQLEKLNNDSKDKFNDIPKEQRAMITSEGAFKYFSKQYGI
TPGYIWEINTEKQGTPEQMRQAIEFVKKHKLKHLLVETSVDKKAMESLSEETKKD
IFGEVYTDSIGKEGTKGDSYYKMMKSNIETVHGSMK (SEQ ID NO:429)

Figure 84

TTAGAAACAAATAAAAATCATGCAACAGCTTGGCAAGGATTTAAAAATGGAAGA
TGGAACAGACACGTAGATGTAAGAGAGTTTATCCAATTAAACTACACTCTTTATG
AAGGTAATGATTCATTTTTAGCAGGACCAACAGAAGCAACTTCTAAACTTTGGGA
ACAAGTAATGCAGTTATCGAAAGAAGAACGTGAACGTGGCGGCATGTGGGATAT
GGACACGAAAGTAGCTTCAACAATCACATCTCATGATGCTGGTTATTTAGACAAA
GATTTAGAAACAATTGTAGGTGTACAAACTGAAAAGCCATTCAAACGTTCAATGC
AACCATTCGGTGGTATTCGTATGGCGAAAGCAGCTTGTGAAGCTTACGGTTACGA
ATTAGACGAAGAAACTGAAAAAATCTTTACAGATTATCGTAAAACACATAACCAA
GGTGTATTCGATGCATATTCTAGAGAAATGTTGAACTGCCGTAAAGCAGGTGTAA
TCACTGGTTTACCTGATGCATACGGACGTGGACGTATTATCGGTGACTATCGTCGT
GTAGCTTTATATGGTGTAGATTTCTTAATGGAAGAAAAAATGCACGACTTCAACA
CGATGTCTACAGAAATGTCAGAAGATGTAATTCGTTTACGTGAAGAATTATCAGA
ACAATATCGTGCATTAAAAGAATTAAAAGAACTTGGGCAAAAATATGGTTTCGAT
TTAAGCCGTCCAGCAGAAAACTTCAAAGAAGCAGTTCAATGGTTATACTTAGCAT
ACCTTGCTGCAATTAAAGAACAAAACGGTGCAGCAATGAGTTTAGGTCGTACATC
AACATACTTAGATATCTATGCTGAACGTGACCTTAAAGCAGGTGTTATTACTGAA
AGCGAAGTTCAAGAAATTATTGACCACTTCATCATGAAATTACGTATTGTTAAATT
TGCTCGTACACCTGATTACAATGAATTATTCTCTGGAGACCCAACTTGGGTAACTG
TATCTATCGGTGGTGTAGGTATTGACGGACGTCCACTTGTTACGAAAAACTCATTC
CGTTTCTTACACTCATTAGATAACTTAGGTCCAGCACCAGAACCAAACTTAACAGT
ATTATGGTCAGTACGTTTACCTGACAACTTCAAAACATACTGTGCAAAAATGAGT
ATTAAAACAAGTTCTATCCAATATGAAAATGATGACATTATGCGTGAAAGCTATG
GCGATGACTATGGTATCGCATGTTGTGTATCAGCGGTGACAATTGGTAAACAAAT
GCAATTCTTCGGTGCACGTGCGAACATAGCTAAAACATTACTTTACGCTATCAATG
GTGGTAAAGATGAAAGTCTGGTGCACAAGTTGGTCCAAACTTCGAAGGTATTAA
CAGCGAAGTATTAGAATATGACGAAGTATTCAAGAAATTTGATCAAATGATGGAT
TGGCTAGCAGGTGTTTACATTAACTCATTAAATGTTATTCACTACATGCACGATAA
ATACAGCTATGAACGTATTGAAATGGCATTACATGATACAGAAATTGTACGTACA
ATGGCAACAGGTATCGCTGGTTTATCAGTAGCAGCTGACTCATTATCTGCAATTAA
ATATGCACAAGTTAAACCAATTCGTAACGAAGAAGGTCTTGTAGTAGACTTTGAA
ATCGAAGGCGACTTCCCTAAATACGGTAACAATGACGACCGTGTAGATGATATCG
CAGTTGATTTAGTAGAACGCTTTATGACTAAATTACGTAGTCATAAAACATATCGT
GATTCAGAACATACAATGAGTGTATTAACAATTACTTCAAACGTTGTATACGTTAA
GAAAACTGGTAACACACCAGACGGACGTAAAGCTGGCGAACCATTTGCACCAGG
TGCAAACCCAATGCATGGCCGTGACCAAAAGGTGCATTATCTTCATTAAGTTCT
GTAGCTAAGATCCCTTACGATTGCTGTAAAGATGGTATTTCAAATACATTCAGTAT
CGTACCAAAATCATTAGGTAAAGAACCAGAAGATCAAAACCGTAACTTAACTAGT
ATGTTAGATGGTTACGCAATGCAATGTGGTCACCACTTAAATATTAACGTATTTAA
CCGTGAAACATTAATAGATGCAATGGAACATCCAGAAGAATATCCACAGTTAACA
ATCCGTGTATCTGGTTACGCTGTTAACTTCATTAAATTAACACGTGAACAACAGTT
AGATGTAATTTCTCGTACATTCCATGAAAGTATGTAA
(SEQ ID NO:430)

Figure 85

ATGTTAGAAACAAATAAAAATCATGCAACAGCTTGGCAAGGATTTAAAAATGGA
AGATGGAACAGACACGTAGATGTAAGAGAGTTTATCCAATTAAACTACACTCTTT
ATGAAGGTAATGATTCATTTTTAGCAGGACCAACAGAAGCAACTTCTAAACTTTG
GGAACAAGTAATGCAGTTATCGAAAGAAGAACGTGAACGTGGCGGCATGTGGGA
TATGGACACGAAAGTAGCTTCAACAATCACATCTCATGATGCTGGTTATTTAGAC
AAAGATTTAGAAACAATTGTAGGTGTACAAACTGAAAAGCCATTCAAACGTTCAA
TGCAACCATTCGGTGGTATTCGTATGGCGAAAGCAGCTTGTGAAGCTTACGGTTA
CGAATTAGACGAAGAAACTGAAAAATCTTTACAGATTATCGTAAAACACATAAC
CAAGGTGTATTCGATGCATATTCTAGAGAAATGTTGAACTGCCGTAAAGCAGGTG
TAATCACTGGTTTACCTGATGCATACGGACGTGGACGTATTATCGGTGACTATCGT
CGTGTAGCTTTATATGGTGTAGATTTCTTAATGGAAGAAAAATGCACGACTTCA
ACACGATGTCTACAGAAATGTCAGAAGATGTAATTCGTTTACGTGAAGAATTATC
AGAACAATATCGTGCATTAAAAGAATTAAAAGAACTTGGACAAAAATATGGTTTC
GATTTAAGCCGTCCAGCAGAAAACTTCAAAGAAGCAGTTCAATGGTTATACTTAG
CATACCTTGCTGCAATTAAAGAACAAAACGGTGCAGCAATGAGTTTAGGTCGTAC
ATCAACATTCTTAGATATCTATGCTGAACGTGACCTTAAAGCAGGTGTTATTACTG
AAAGCGAAGTTCAAGAAATTATTGACCACTTCATCATGAAATTACGTATTGTTAA
ATTTGCTCGTACACCTGATTACAATGAATTATTCTCTGGAGACCCAACTTGGGTAA
CTGAATCTATCGGTGGTGTAGGTATTGACGGACGTCCACTTGTTACGAAAAACTC
ATTCCGTTTCTTACACTCATTAGATAACTTAGGTCCAGCACCAGAACCAAACTTAA
CAGTATTATGGTCAGTACGTTTACCTGACAACTTCAAAACATACTGTGCAAAAAT
GAGTATTAAAACAAGTTCTATCCAATATGAAAATGATGACATTATGCGTGAAAGC
TATGGCGATGACTATGGTATCGCATGTTGTGTATCAGCGATGACAATTGGTAAAC
AAATGCAATTCTTCGGTGCACGTGCGAACTTAGCTAAAACATTACTTTACGCTATC
AATGGTGGTAAAGATGAAAAATCTGGCGCACAAGTTGGTCCAAACTTCGAAGGTA
TTAACAGCGAAGTATTAGAATATGACGAAGTATTCAAGAAATTTGATCAAATGAT
GGATTGGCTAGCAGGTGTTTACATTAACTCATTAAATGTTATTCACTACATGCACG
ATAAATACAGCTATGAACGTATTGAAATGGCATTACATGATACAGAAATTGTACG
TACAATGGCAACAGGTATCGCTGGTTTATCAGTAGCAGCTGACTCATTATCTGCAA
TTAAATATGCACAAGTTAAACCAATTCGTAACGAAGAAGGTCTTGTAGTAGACTT
TGAAATCGAAGGCGACTTCCCTAAATACGGTAACAATGACGACCGTGTAGATGAT
ATCGCAGTTGATTTAGTAGAACGCTTTATGACTAAATTACGTAGTCATAAAACATA
TCGTGATTCAGAACATACAATGAGTGTATTAACAATTACTTCAAACGTTGTATACG
GTAAGAAACTGGTAACACACCAGACGGACGTAAAGCTGGCGAACCATTTGCAC
CAGGTGCAAACCCAATGCATGGCCGTGACCAAAAGGTGCATTATCTTCATTAAG
TTCTGTAGCTAAGATCCCTTACGATTGCTGTAAAGATGGTATTTCAAATACATTCA
GTATCGTACCAAAATCATTAGGTAAAGAACCAGAAGATCAAAACCGTAACTTAAC
TAGTATGTTAGATGGTTACGCAATGCAATGTGGTCACCACTTAAATATTAACGTAT
TTAACCGTGAAACATTAATAGATGCAATGGAACATCCAGAAGAATATCCACAGTT
AACAATCCGTGTATCTGGTTACGCTGTTAACTTCATTAAATTAACACGTGAACAAC
AATTAGATGTAATTTCTCGTACATTCCATGAAAGTATGTAA
(SEQ ID NO:431)

Figure 86

ATGTTAGAAACAAATAAAAATCATGCAACAGCTTGGCAAGGATTTAAAAATGGA
AGATGGAACAGACACGTAGATGTAAGAGAGTTTATCCAATTAAACTACACTCTTT
ATGAAGGTAATGATTCATTTTAGCAGGACCAACAGAAGCAACTTCTAAACTTTG
GAACAAGTAATGCAGTTATCGAAAGAAGAACGTGAACGTGGCGGCATGTGGA
TATGGACACGAAAGTAGCTTCAACAATCACATCTCATGATGCTGGTTATTTAGAC
AAAGATTTAGAAACAATTGTAGGTGTACAAACTGAAAGCCATTCAAACGTTCAA
TGCAACCATTCGGTGGTATTCGTATGGCGAAAGCAGCTTGTGAAGCTTACGGTTA
CGAATTAGACGAAGAAACTGAAAAATCTTTACAGATTATCGTAAAACACATAAC
CAAGGTGTATTCGATGCATATTCTAGAGAAATGTTGAACTGCCGTAAAGCAGGTG
TAATCACTGGTTTACCTGATGCATACGGACGTGGACGTATTATCGGTGACTATCGT
CGTGTAGCTTTATATGGTGTAGATTTCTTAATGGAAGAAAAATGCACGACTTCA
ACACGATGTCTACAGAAATGTCAGAAGATGTAATTCGTTTACGTGAAGAATTATC
AGAACAATATCGTGCATTAAAAGAATTAAAAGAACTTGGACAAAATATGGTTTC
GATTTAAGCCGTCCAGCAGAAACTTCAAAGAAGCAGTTCAATGGTTATACTTAG
CATACCTTGCTGCAATTAAAGAACAAAACGGTGCAGCAATGAGTTTAGGTCGTAC
ATCAACATTCTTAGATATCTATGCTGAACGTGACCTTAAAGCAGGCGTTATTACTG
AAAGCGAAGTTCAAGAAATTATTGACCACTTCATCATGAATTACGTATTGTTAA
ATTTGCTCGTACACCTGATTACAATGAATTATTCTCTGGAGACCCAACTTGGGTAA
CTGAATCTATCGGTGGTGTAGGTATTGACGGACGTCCACTTGTTACGAAAAACTC
ATTCCGTTTCTTACACTCATTAGATAACTTAGGTCCAGCTCCAGAACCAAACTTAA
CAGTATTATGGTCAGTACGTTTACCTGACAACTTCAAAACATACTGTGCAAAAAT
GAGTATTAAAACAAGTTCTATCCAATATGAAAATGATGACATTATGCGCGAAAGC
TATGGCGATGACTATGGTATCGCATGTTGTGTATCAGCGATGACAATTGGTAAAC
AAATGCAATTCTTCGGTGCACGTGCGAACTTAGCTAAAACATTACTTTACGCAATC
AATGGTGGTAAAGATGAAAAATCTGGTGCACAAGTTGGTCCAAACTTCGAAGGTA
TTAACAGCGAAGTATTAGAATATGACGAAGTATTCAAGAAATTTGATCAAATGAT
GGATTGGCTAGCAGGTGTTTACATTAACTCATTAAATGTTATTCACTACATGCACG
ATAAATACAGCTATGAACGTATTGAAATGGCATTACATGATACAGAAATTGTACG
TACAATGGCAACAGGTATCGCTGGTTTATCAGTAGCAGCTGACTCATTATCTGCAA
TTAAATATGCACAAGTTAAACCAATTCGTAACGAAGAAGGTCTTGTAGTAGACTT
TGAAATCGAAGGCGACTTCCCTAAATACGGTAACAATGACGACCGTGTAGATGAT
ATCGCAGTTGATTTAGTAGAACGCTTCATGACTAAATTACGTAGTCATAAAACAT
ATCGTGATTCAGAACATACAATGAGTGTATTAACAATTACTTCAAACGTTGTATAC
GGTAAGAAAACTGGTAACACACCAGACGGACGTAAAGCTGGCGAACCATTTGCTC
CAGGTGCAAACCCAATGCATGGCCGTGACCAAAAAGGTGCATTATCTTCATTAAG
TTCTGTAGCTAAGATCCCTTACGATTGCTGTAAAGATGGTATTTCAAATACATTCA
GTATCGTACCAAAATCATTAGGTAAAGAACCAGAAGATCAAAACCGTAACTTAAC
TAGTATGTTAGATGGTTACGCAATGCAATGTGGTCACCACTTAAATATTAACGTAT
TTAACCGTGAAACATTAATAGATGCAATGGAACATCCAGAAGAATATCCACAGTT
AACAATCCGTGTATCTGGTTACGCTGTTAACTTCATTAAATTAACACGTGAACAAC
AATTAGATGTAATTTCTCGTACATTCCATGAAAGTATGTAA
(SEQ ID NO:432)

Figure 87

ATGTTAGAAACAAATAAAAATCATGCAACAGCTTGGCAAGGATTTAAAAATGGA
AGATGGAACAGACACGTAGATGTAAGAGAGTTTATCCAATTAAACTACACTCTTT
ATGAAGGTAATGATTCATTTTTAGCAGGACCAACAGAAGCAACTTCTAAACTTTG
GGAACAAGTAATGCAGTTATCGAAAGAAGAACGTGAACGTGGCGGCATGTGGGA
TATGGACACGAAAGTAGCTTCAACAATCACATCTCATGATGCTGGTTATTTAGAC
AAAGATTTAGAAACAATTGTAGGTGTACAAACTGAAAGCCATTCAAACGTTCAA
TGCAACCATTCGGTGGTATTCGTATGGCGAAAGCAGCTTGTGAAGCTTACGGTTA
CGAATTAGACGAAGAAACTGAAAAATCTTTACAGATTATCGTAAAACACATAAC
CAAGGTGTATTCGATGCATATTCTAGAGAAATGTTGAACTGCCGTAAAGCAGGTG
TAATCACTGGTTTACCTGATGCATACGGGCGTGGACGTATTATCGGTGACTATCGT
CGTGTAGCTTTATATGGTGTAGATTTCTTAATGGAAGAAAAATGCACGACTTCA
ACACGATGTCTACAGAAATGTCAGAAGATGTAATTCGTTTACGTGAAGAATTATC
AGAACAATATCGTGCATTAAAAGAATTAAAAGAACTTGGACAAAAATATGGTTTC
GATTTAAGCCGTCCAGCAGAAAACTTCAAAGAAGCAGTTCAATGGTTATACTTAG
CATACCTTGCTGCAATTAAAGAACAAAACGGTGCAGCAATGAGTTTAGGTCGTAC
ATCAACATTCTTAGATATCTATGCTGAACGTGACCTTAAAGCAGGTGTTATTACTG
AAAGCGAAGTTCAAGAATTATTGACCACTTCATCATGAAATTACGTATTGTTAA
ATTTGCTCGTACACCTGATTACAATGAATTATTCTCTGGAGACCCAACTTGGGTAA
CTGAATCTATCGGTGGTGTAGGTATTGACGGACGTCCACTTGTTACGAAAAACTC
ATTCCGTTTCTTACACTCATTAGATAACTTAGGTCCAGCACCAGAACCAAACTTAA
CAGTATTATGGTCAGTACGTTACCAGACAACTTCAAAACATACTGTGCAAAAAT
GAGTATTAAAACAAGTTCTATCCAATATGAAAATGATGACATTATGCGTGAAAGC
TATGGCGATGACTATGGTATCGCATGTTGTGTATCAGCGATGACAATTGGTAAAC
AAATGCAATTCTTCGGTGCACGTGCGAACTTAGCTAAAACATTACTTTACGCTATC
AATGGTGGTAAAGATGAAAAATCTGGTGCACAAGTTGGTCCAAACTTCGAAGGTA
TTAACAGCGAAGTATTAGAATATGACGAAGTATTCAAGAAATTTGATCAAATGAT
GGATTGGCTAGCAGGTGTTTACATTAACTCATTAAATGTTATTCACTACATGCACG
ATAAATACAGCTATGAACGTATTGAAATGGCATTACATGATACAGAAATTGTACG
TACAATGGCAACAGGTATCGCTGGTTTATCAGTAGCAGCTGACTCATTATCTGCAA
TTAAATATGCACAAGTTAAACCAATTCGTAACGAAGAAGGTCTTGTAGTAGACTT
TGAAATCGAAGGCGACTTCCCTAAATACGGTAACAATGACGACCGTGTAGATGAT
ATCGCAGTTGATTTAGTAGAACGCTTTATGACTAAATTACGTAGTCATAAAACATA
TCGTGATTCAGAACATACAATGAGTGTATTAACAATTACTTCAAACGTTGTATACG
GTAAGAAACTGGTAACACACCAGACGGACGTAAAGCTGGCGAACCATTTGCAC
CAGGTGCAAACCCAATGCATGGCCGTGACCAAAAAGGTGCATTATCTTCATTAAG
TTCTGTAGCTAAGATTCCTTACGATTGCTGTAAAGATGGTATTTCAAATACATTCA
GTATCGTACCAAAATCATTAGGTAAAGAACCAGAAGATCAAAACCGTAACTTAAC
TAGTATGTTAGATGGTTACGCAATGCAATGTGGTCACCACTTAAATATTAACGTAT
TTAACCGTGAAACATTAATAGATGCAATGGAACATCCAGAAGAATATCCACAGTT
AACAATCCGTGTATCTGGTTACGCTGTTAACTTCATTAAATTAACACGTGAACAAC
AATTAGATGTAATTTCTCGTACATTCCATGAAAGTATGTAA
(SEQ ID NO:433)

Figure 88
ATGTTAGAAACAAATAAAAATCATGCAACAGCTTGGCAAGGATTTAAAAATGGA
AGATGGAACAGACACGTAGATGTAAGAGAGTTTATCCAATTAAACTACACTCTTT
ATGAAGGTAATGATTCATTTTTAGCAGGACCAACAGAAGCAACTTCTAAACTTTG
GGAACAAGTAATGCAGTTATCGAAAGAAGAACGTGAACGTGGCGGCATGTGGGA
TATGGACACGAAAGTAGCTTCAACAATCACATCTCATGATGCTGGTTATTTAGAC
AAAGATTTAGAAACAATTGTAGGTGTACAAACTGAAAAGCCATTCAAACGTTCAA
TGCAACCATTCGGTGGTATTCGTATGGCGAAAGCAGCTTGTGAAGCTTACGGTTA
CGAATTAGACGAAGAAACTGAAAAAATCTTTACAGATTATCGTAAAACACATAAC
CAAGGTGTATTCGATGCATATTCTAGAGAAATGTTGAACTGCCGTAAAGCAGGTG
TAATCACTGGTTTACCTGATGCATACGGACGTGGACGTATTATCGGTGACTATCGT
CGTGTAGCTTTATATGGTGTAGATTTCTTAATGGAAGAAAAATGCACGACTTCA
ACACGATGTCTACAGAAATGTCAGAAGATGTAATTCGTTTACGTGAAGAATTATC
AGAACAATATCGTGCATTAAAAGAATTAAAAGAACTTGGACAAAAATATGGTTTC
GATTTAAGCCGTCCAGCAGAAAACTTCAAGAAGCAGTTCAATGGTTATACTTAG
CATACCTTGCTGCAATTAAAGAACAAAACGGTGCAGCAATGAGTTTAGGTCGTAC
ATCAACATTCTTAGATATCTATGCTGAACGTGACCTTAAAGCAGGCGTTATTACTG
AAAGCGAAGTTCAAGAAATTATTGACCACTTCATCATGAAATTACGTATTGTTAA
ATTTGCTCGTACACCTGATTACAATGAATTATTCTCTGGAGACCCAACTTGGGTAA
CTGAATCTATCGGTGGTGTAGGTATTGACGGACGTCCACTTGTTACGAAAAACTC
ATTCCGTTTCTTACACTCATTAGATAACTTAGGTCCAGCTCCAGAACCAAACTTAA
CAGTATTATGGTCAGTACGTTTACCTGACAACTTCAAAACATACTGTGCAAAAAT
GAGTATTAAAACAAGTTCTATCCAATATGAAAATGATGACATTATGCGTGAAAGC
TATGGCGATGACTATGGTATCGCATGTTGTGTATCAGCGATGACAATTGGTAAAC
AAATGCAATTCTTCGGTGCACGTGCGAACTTAGCTAAAACATTACTTTACGCTATC
AATGGTGGTAAAGATGAAAAATCTGGTGCACAAGTTGGTCCAAACTTCGAAGGTA
TTAACAGCGAAGTATTAGAATATGACGAAGTATTCAAGAAATTTGATCAAATGAT
GGATTGGCTAGCAGGTGTTTACATTAACTCATTAAATGTTATTCACTACATGCACG
ATAAATACAGCTATGAACGTATTGAAATGGCATTACATGATACAGAAATTGTACG
TACAATGGCAACAGGTATCGCTGGTTTATCAGTAGCAGCTGACTCATTATCTGCAA
TTAAATATGCACAAGTTAAACCAATTCGTAACGAAGAAGGTCTTGTAGTAGACTT
TGAAATCGAAGGCGACTTCCCTAAATACGGTAACAATGACGACCGTGTAGATGAT
ATCGCAGTTGATTTAGTAGAACGCTTTATGACTAAATTACGTAGTCATAAAACATA
TCGTGATTCAGAACATACAATGAGTGTATTAACAATTACTTCAAACGTTGTATACG
GTAAGAAAACTGGTAACACACCAGACGGACGTAAAGCTGGCGAACCATTTGCAC
CAGGTGCAAACCCAATGCATGGCCGTGACCAAAAGGTGCATTATCTTCATTAAG
TTCTGTAGCTAAGATCCCTTACGATTGCTGTAAAGATGGTATTTCAAATACATTCA
GTATCGTACCAAAATCATTAGGTAAAGAACCAGAAGATCAAACCGTAACTTAAC
TAGTATGTTAGATGGTTACGCAATGCAATGTGGTCACCACTTAAATATTAACGTAT
TTAACCGTGAAACATTAATAGATGCAATGGAACATCCAGAAGAATATCCACAGTT
AACAATCCGTGTATCTGGTTACGCTGTTAACTTCATTAAATTAACACGTGAACAAC
AATTAGATGTAATTTCTCGTACATTCCATGA AAGTATGTAA
(SEQ ID NO:434)

Figure 89
ATGTTAGAAACAAATAAAAATCATGCAACAGCTTGGCAAGGATTTAAAAATGGAAGA
TGGAACAGACACGTAGATGTAAGAGAGTTTATCCAATTAAACTACACTCTTTATGAAG
GTAATGATTCATTTTTAGCAGGACCAACAGAAGCAACTTCTAAACTTTGGGAACAAGT
AATGCAGTTATCGAAAGAAGAACGTGAACGTGGCGGCATGTGGGATATGGACACGAA
AGTAGCTTCAACAATCACATCTCATGATGCTGGTTATTTAGACAAAGATTTAGAAACA
ATTGTAGGTGTACAAACTGAAAAGCCATTCAAACGTTCAATGCAACCATTCGGTGGTA
TTCGTATGGCGAAAGCAGCTTGTGAAGCTTACGGTTACGAATTAGACGAAGAAACTG
AAAAAATCTTTACAGATTATCGTAAAACACATAACCAAGGTGTATTCGATGCATATTC
TAGAGAAATGTTGAACTGCCGTAAAGCAGGTGTAATCACTGGTTTACCTGATGCATAC
GGACGTGGACGTATTATCGGTGACTATCGTCGTGTAGCTTTATATGGTGTAGATTTCTT
AATGGAAGAAAAAATGCACGACTTCAACACGATGTCTACAGAAATGTCAGAAGATGT
AATTCGTTTACGTGAAGAATTATCAGAACAATATCGTGCATTAAAAGAATTAAAAGA
ACTTGGACAAAATATGGTTTCGATTTAAGCCGTCCAGCAGAAAACTTCAAAGAAGC
AGTTCAATGGTTATACTTAGCATACCTTGCTGCAATTAAAGAACAAAACGGTGCAGCA
ATGAGTTTAGGTCGTACATCAACATTCTTAGATATCTATGCTGAACGTGACCTTAAAG
CAGGCGTTATTACTGAAAGCGAAGTTCAAGAAATTATTGACCACTTCATCATGAAATT
ACGTATTGTTAAATTTGCTCGTACACCTGATTACAATGAATTATTCTCTGGAGACCCAA
CTTGGGTAACTGAATCTATCGGTGGTGTAGGTATTGACGGACGTCCACTTGTTACGAA
AAACTCATTCCGTTTCTTACACTCATTAGATAACTTAGGTCCAGCTCCAGAACCAAAC
TTAACAGTATTATGGTCAGTACGTTTACCTGACAACTTCAAAACATACTGTGCAAAAA
TGAGTATTAAAACAAGTTCTATCCAATATGAAAATGATGACATTATGCGTGAAAGCTA
TGGCGATGACTATGGTATCGCATGTTGTGTATCAGCGATGACAATTGGTAAACAAATG
CAATTCTTCGGTGCACGTGCGAACTTAGCTAAAACATTACTTTACGCTATCAATGGTG
GTAAAGATGAAAAATCTGGTGCACAAGTTGGTCCAAACTTCGAAGGTATTAACAGCG
AAGTATTAGAATATGACGAAGTATTCAAGAAATTTGATCAAATGATGGATTGGCTAGC
AGGTGTTTACATTAACTCATTAAATGTTATTCACTACATGCACGATAAATACAGCTAT
GAACGTATTGAAATGGCATTACATGATACAGAAATTGTACGTACAATGGCAACAGGT
ATCGCTGGTTTATCAGTAGCAGCTGACTCATTATCTGCAATTAAATATGCACAAGTTA
AACCAATTCGTAACGAAGAAGGTCTTGTAGTAGACTTTGAAATCGAAGGCGACTTCCC
TAAATACGGTAACAATGACGACCGTGTAGATGATATTGCAGTTGATTTAGTAGAACGC
TTCATGACTAAATTACGTAGTCATAAAACATATCGTGATTCAGAACATACAATGAGTG
TATTAACAATTACTTCAAACGTTGTATACGGTAAGAAAACTGGTAACACACCAGACGG
ACGTAAAGCTGGCGAACCATTTGCTCCAGGTGCAAACCCAATGCATGGCCGTGACCA
AAAAGGTGCATTATCTTCATTAAGTTCTGTAGCTAAGATCCCTTACGATTGCTGTAAA
GATGGTATTTCAAATACATTCAGTATCGTACCAAAATCATTAGGTAAAGAACCAGAAG
ATCAAACCGTAACTTAACTAGTATGTTAGATGGTTACGCAATGCAATGTGGTCACCA
CTTAAATATTAACGTATTTAACCGTGAAACATTAATAGATGCAATGGAACATCCAGAA
GAATATCCACAGTTAACAATCCGTGTATCTGGTTACGCTGTTAACTTCATTAAATTAAC
ACGTGAACAACAATTAGATGTAATTTCTCGTACATTCCATGAAAGTATGTAA
(SEQ ID NO:435)

Figure 90

```
ATGTTAGAAACAAATAAAAATCATGCAACAGCTTGGCAAGGATTTAAAAATGGA
AGATGGAACAGACACGTAGATGTAAGAGAGTTTATCCAATTAAACTACACTCTTT
ATGAAGGTAATGATTCATTTTTAGCAGGACCAACAGAAGCAACTTCTAAACTTTG
GGAACAAGTAATGCAGTTATCGAAAGAAGAACGTGAACGTGGCGGCATGTGGGA
TATGGACACGAAAGTAGCTTCAACAATCACATCTCATGATGCTGGTTATTTAGAC
AAAGATTTAGAAACAATTGTAGGTGTACAAACTGAAAAGCCATTCAAACGTTCAA
TGCAACCATTCGGTGGTATTCGTATGGCGAAAGCAGCTTGTGAAGCTTACGGTTA
CGAATTAGACGAAGAAACTGAAAAATCTTTACAGATTATCGTAAAACACATAAC
CAAGGTGTATTCGATGCATATTCTAGAGAAATGTTGAACTGCCGTAAAGCAGGTG
TAATCACTGGTTTACCTGATGCATACGGACGTGGACGTATTATCGGTGACTATCGT
CGTGTAGCTTTATATGGTGTAGATTTCTTAATGGAAGAAAAATGCACGACTTCA
ACACGATGTCTACAGAAATGTCAGAAGATGTAATTCGTTTACGTGAAGAATTATC
AGAACAATATCGTGCATTAAAAGAATTAAAAGAACTTGGACAAAATATGGTTTC
GATTTAAGCCGTCCAGCAGAAAACTTCAAAGAAGCAGTTCAATGGTTATACTTAG
CATACCTTGCTGCAATTAAAGAACAAAACGGTGCAGCAATGAGTTTAGGTCGTAC
ATCAACATTCTTAGATATCTATGCTGAACGTGACCTTAAAGCAGGCGTTATTACTG
AAAGCGAAGTTCAAGAAATTATTGACCACTTCATCATGAAATTACGTATTGTAA
ATTTGCTCGTACACCTGATTACAATGAATTATTCTCTGGAGACCCAACTTGGGTAA
CTGAATCTATCGGTGGTGTAGGTATTGACGGACGTCCACTTGTTACGAAAAACTC
ATTCCGTTTCTTACACTCATTAGATAACTTAGGTCCAGCTCCAGAACCAAACTTAA
CAGTATTATGGTCAGTACGTTTACCTGACAACTTCAAAACATACTGTGCAAAAAT
GAGTATTAAAACAAGTTCTATCCAATATGAAAATGATGACATTATGCGCGAAAGC
TATGGCGATGACTATGGTATCGCATGTTGTGTATCAGCGATGACAATTGGTAAAC
AAATGCAATTCTTCGGTGCACGTGCGAACTTAGCTAAAACATTACTTTACGCAATC
AATGGTGGTAAAGATGAAAAATCTGGTGCACAAGTTGGTCCAAACTTCGAAGGTA
TTAACAGCGAAGTATTAGAATATGACGAAGTATTCAAGAAATTTGATCAAATGAT
GGATTGGCTAGCAGGTGTTTACATTAACTCATTAAATGTTATTCACTACATGCACG
ATAAATACAGCTATGAACGTATTGAAATGGCATTACATGATACAGAAATTGTACG
TACAATGGCAACAGGTATCGCTGGTTTATCAGTAGCAGCTGACTCATTATCTGCAA
TTAAATATGCACAAGTTAAACCAATTCGTAACGAAGAAGGTCTTGTAGTAGACTT
TGAAATCGAAGGCGACTTCCCTAAATACGGTAACAATGACGACCGTGTAGATGAT
ATCGCAGTTGATTTAGTAGAACGCTTCATGACTAAATTACGTAGTCATAAAACAT
ATCGTGATTCAGAACATACAATGAGTGTATTAACAATTACTTCAAACGTTGTATAC
GGTAAGAAAACTGGTAACACACCAGACGGACGTAAAGCTGGCGAACCATTTGCTC
CAGGTGCAAACCCAATGCATGGCCGTGACCAAAAAGGTGCATTATCTTCATTAAG
TTCTGTAGCTAAGATCCCTTACGATTGCTGTAAAGATGGTATTTCAAATACATTCA
GTATCGTACCAAAATCATTAGGTAAAGAACCAGAAGATCAAAACCGTAACTTAAC
TAGTATGTTAGATGGTTACGCAATGCAATGTGGTCACCACTTAAATATTAACGTAT
TTAACCGTGAAACATTAATAGATGCAATGGAACATCCAGAAGAATATCCACAGTT
AACAATCCGTGTATCTGGTTACGCTGTTAACTTCATTAAATTAACACGTGAACAAC
AATTAGATGTAATTTCTCGTACATTCCATGAAAGTATGTAA
```
(SEQ ID NO:436)

Figure 91

```
ATGTTAGAAACAAATAAAAATCATGCAACAGCTTGGCAAGGATTTAAAAATGGA
AGATGGAACAGACACGTAGATGTAAGAGAGTTTATCCAATTAAACTACACTCTTT
ATGAAGGTAATGATTCATTTTTAGCAGGACCAACAGAAGCAACTTCTAAACTTTG
GGAACAAGTAATGCAGTTATCGAAAGAAGAACGTGAACGTGGCGGCATGTGGA
TATGGACACGAAAGTAGCTTCAACAATCACATCTCATGATGCTGGTTATTTAGAC
AAAGATTTAGAAACAATTGTAGGTGTACAAACTGAAAAGCCATTCAAACGTTCAA
TGCAACCATTCGGTGGTATTCGTATGGCGAAAGCAGCTTGTGAAGCTTACGGTTA
CGAATTAGACGAAGAAACTGAAAAAATCTTTACAGATTATCGTAAAACACATAAC
CAAGGTGTATTCGATGCATATTCTAGAGAAATGTTGAACTGCCGTAAAGCAGGTG
TAATCACTGGTTTACCTGATGCATACGGACGTGGACGTATTATCGGTGACTATCGT
CGTGTAGCTTTATATGGTGTAGATTTCTTAATGGAAGAAAAAATGCACGACTTCA
ACACGATGTCTACAGAAATGTCAGAAGATGTAATTCGTTTACGTGAAGAATTATC
AGAACAATATCGTGCATTAAAAGAATTAAAAGAACTTGGACAAAAATATGGTTTC
GATTTAAGCCGTCCAGCAGAAAACTTCAAAGAAGCAGTTCAATGGTTATACTTAG
CATACCTTGCTGCAATTAAAGAACAAAACGGTGCAGCAATGAGTTTAGGTCGTAC
ATCAACATTCTTAGATATCTATGCTGAACGTGACCTTAAAGCAGGCGTTATTACTG
AAAGCGAAGTTCAAGAAATTATTGACCACTTCATCATGAAATTACGTATTGTTAA
ATTTGCTCGTACACCTGATTACAATGAATTATTCTCTGGAGACCCAACTTGGGTAA
CTGAATCTATCGGTGGTGTAGGTATTGACGGACGTCCACTTGTTACGAAAAACTC
ATTCCGTTTCTTACACTCATTAGATAACTTAGGTCCAGCTCCAGAACCAAACTTAA
CAGTATTATGGTCAGTACGTTTACCTGACAACTTCAAAACATACTGTGCAAAAAT
GAGTATTAAAACAAGTTCTATCCAATATGAAAATGATGACATTATGCGTGAAAGC
TATGGCGATGACTATGGTATCGCATGTTGTGTATCAGCGATGACAATTGGTAAAC
AAATGCAATTCTTCGGTGCACGTGCGAACTTAGCTAAAACATTACTTTACGCTATC
AATGGTGGTAAAGATGAAAAATCTGGTGCACAAGTTGGTCCAAACTTCGAAGGTA
TTAACAGCGAAGTATTAGAATATGACGAAGTATTCAAGAAATTTGATCAAATGAT
GGATTGGCTAGCAGGTGTTTACATTAACTCATTAAATGTTATTCACTACATGCACG
ATAAATACAGCTATGAACGTATTGAAATGGCATTACATGATACAGAAATTGTACG
TACAATGGCAACAGGTATCGCTGGTTTATCAGTAGCAGCTGACTCATTATCTGCAA
TTAAATATGCACAAGTTAAACCAATTCGTAACGAAGAAGGTCTTGTAGTAGACTT
TGAAATCGAAGGCGACTTCCCTAAATACGGTAACAATGACGACCGTGTAGATGAT
ATTGCAGTTGATTTAGTAGAACGCTTCATGACTAAATTACGTAGTCATAAAACATA
TCGTGATTCAGAACATACAATGAGTGTATTAACAATTACTTCAAACGTTGTATACG
GTAAGAAAACTGGTAACACACCAGACGGACGTAAAGCTGGCGAACCATTTGCTCC
AGGTGCAAACCCAATGCATGGCCGTGACCAAAAAGGTGCATTATCTTCATTAAGT
TCTGTAGCTAAGATCCCTTACGATTGCTGTAAAGATGGTATTTCAAATACATTCAG
TATCGTACCAAAATCATTAGGTAAAGAACCAGAAGATCAAAACCGTAACTTAACT
AGTATGTTAGATGGTTACGCAATGCAATGTGGTCACCACTTAAATATTAACGTATT
TAACCGTGAAACATTAATAGATGCAATGGAACATCCAGAAGAATATCCACAGTTA
ACAATCCGTGTATCTGGTTACGCTGTTAACTTCATTAAATTAACACGTGAACAACA
ATTAGATGTAATTTCTCGTACATTCCATGAAAGTATGTAA
```
(SEQ ID NO:437)

Figure 92

ATGTTAGAAACAAATAAAAATCATGCAACAGCTTGGCAAGGATTTAAAAATGGAAGA
TGGAACAGACACGTAGATGTAAGAGAGTTTATCCAATTAAACTACACTCTTTATGAAG
GTAATGATTCATTTTTAGCAGGACCAACAGAAGCAACTTCTAAACTTTGGGAACAAGT
AATGCAGTTATCGAAAGAAGAACGTGAACGTGGCGGCATGTGGGATATGGACACGAA
AGTAGCTTCAACAATCACATCTCATGATGCTGGTTATTTAGACAAAGATTTAGAAACA
ATTGTAGGTGTACAAACTGAAAAGCCATTCAAACGTTCAATGCAACCATTCGGTGGTA
TTCGTATGGCGAAAGCAGCTTGTGAAGCTTACGGTTACGAATTAGACGAAGAAACTG
AAAAAATCTTTACAGATTATCGTAAAACACATAACCAAGGTGTATTCGATGCATATTC
TAGAGAAATGTTGAACTGCCGTAAAGCAGGTGTAATCACTGGTTTACCTGATGCATAC
GGACGTGGACGTATTATCGGTGACTATCGTCGTGTAGCTTTATATGGTGTAGATTTCTT
AATGGAAGAAAAAATGCACGACTTCAACACGATGTCTACAGAAATGTCAGAAGATGT
AATTCGTTTACGTGAAGAATTATCAGAACAATATCGTGCATTAAAAGAATTAAAAGA
ACTTGGACAAAAATATGGTTTCGATTTAAGCCGTCCAGCAGAAAACTTCAAAGAAGC
AGTTCAATGGTTATACTTAGCATACCTTGCTGCAATTAAAGAACAAAACGGTGCAGCA
ATGAGTTTAGGTCGTACATCAACATTCTTAGATATCTATGCTGAACGTGACCTTAAAG
CAGGCGTTATTACTGAAAGCGAAGTTCAAGAAATTATTGACCACTTCATCATGAAATT
ACGTATTGTTAAATTTGCTCGTACACCTGATTACAATGAATTATTCTCTGGAGACCCAA
CTTGGGTAACTGAATCTATCGGTGGTGTAGGTATTGACGGACGTCCACTTGTTACGAA
AAACTCATTCCGTTTCTTACACTCATTAGATAACTTAGGTCCAGCTCCAGAACCAAAC
TTAACAGTATTATGGTCAGTACGTTTACCTGACAACTTCAAAACATACTGTGCAAAAA
TGAGTATTAAAACAAGTTCTATCCAATATGAAAATGATGACATTATGCGTGAAAGCTA
TGGCGATGACTATGGTATCGCATGTTGTGTATCAGCGATGACAATTGGTAAACAAATG
CAATTCTTCGGTGCACGTGCGAACTTAGCTAAAACATTACTTTACGCTATCAATGGTG
GTAAAGATGAAAAATCTGGTGCACAAGTTGGTCCAAACTTCGAAGGTATTAACAGCG
AAGTATTAGAATATGACGAAGTATTCAAGAAATTTGATCAAATGATGGATTGGCTAGC
AGGTGTTTACATTAACTCATTAAATGTTATTCACTACATGCACGATAAATACAGCTAT
GAACGTATTGAAATGGCATTACATGATACAGAATTGTACGTACAATGGCAACAGGT
ATCGCTGGTTTATCAGTAGCAGCTGACTCATTATCTGCAATTAAATATGCACAAGTTA
AACCAATTCGTAACGAAGAAGGTCTTGTAGTAGACTTTGAAATCGAAGGCGACTTCCC
TAAATACGGTAACAATGACGACCGTGTAGATGATATTGCAGTTGATTTAGTAGAACGC
TTCATGACTAAATTACGTAGTCATAAAACATATCGTGATTCAGAACATACAATGAGTG
TATTAACAATTACTTCAAACGTTGTATACGGTAAGAAAACTGGTAACACACCAGACGG
ACGTAAAGCTGGCGAACCATTTGCTCCAGGTGCAAACCCAATGCATGGCCGTGACCA
AAAAGGTGCATTATCTTCATTAAGTTCTGTAGCTAAGATCCCTTACGATTGCTGTAAA
GATGGTATTTCAAATACATTCAGTATCGTACCAAAATCATTAGGTAAAGAACCAGAAG
ATCAAAACCGTAACTTAACTAGTATGTTAGATGGTTACGCAATGCAATGTGGTCACCA
CTTAAATATTAACGTATTTAACCGTGAAACATTAATAGATGCAATGGAACATCCAGAA
GAATATCCACAGTTAACAATCCGTGTATCTGGTTACGCTGTTAACTTCATTAAATTAAC
ACGTGAACAACAATTAGATGTAATTTCTCGTACATTCCATGAAAGTATGTAA
(SEQ ID NO:438)

Figure 93

ATGTTAGAAACAAATAAAAATCATGCAACAGCTTGGCAAGGATTTAAAAATGGA
AGATGGAACAGACACGTAGATGTAAGAGAGTTTATCCAATTAAACTACACTCTTT
ATGAAGGTAATGATTCATTTTTAGCAGGACCAACAGAAGCAACTTCTAAACTTTG
GGAACAAGTAATGCAGTTATCGAAAGAAGAACGTGAACGTGGCGGCATGTGGGA
TATGGACACGAAAGTAGCTTCAACAATCACATCTCATGATGCTGGTTATTTAGAC
AAAGATTTAGAAACAATTGTAGGTGTACAAACTGAAAAGCCATTCAAACGTTCAA
TGCAACCATTCGGTGGTATTCGTATGGCGAAAGCAGCTTGTGAAGCTTACGGTTA
CGAATTAGACGAAGAAACTGAAAAAATCTTTACAGATTATCGTAAAACACATAAC
CAAGGTGTATTCGATGCATATTCTAGAGAAATGTTGAACTGCCGTAAAGCAGGTG
TAATCACTGGTTTACCTGATGCATACGGACGTGGACGTATTATCGGTGACTATCGT
CGTGTAGCTTTATATGGTGTAGATTCTTAATGGAAGAAAAATGCACGACTTCA
ACACGATGTCTACAGAAATGTCAGAAGATGTAATTCGTTACGTGAAGAATTATC
AGAACAATATCGTGCATTAAAAGAATTAAAAGAACTTGGACAAAATATGGTTTC
GATTTAAGCCGTCCAGCAGAAAACTTCAAAGAAGCAGTTCAATGGTTATACTTAG
CATACCTTGCTGCAATTAAAGAACAAAACGGTGCAGCAATGAGTTTAGGTCGTAC
ATCAACATTCTTAGATATCTATGCTGAACGTGACCTTAAAGCAGGCGTTATTACTG
AAAGCGAAGTTCAAGAAATTATTGACCACTTCATCATGAATTACGTATTGTTAA
ATTTGCTCGTACACCTGATTACAATGAATTATTCTCTGGAGACCCAACTTGGGTAA
CTGAATCTATCGGTGGTGTAGGTATTGACGGACGTCCACTTGTTACGAAAAACTC
ATTCCGTTTCTTACACTCATTAGATAACTTAGGTCCAGCTCCAGAACCAAACTTAA
CAGTATTATGGTCAGTACGTTTACCTGACAACTTCAAAACATACTGTGCAAAAAT
GAGTATTAAAACAAGTTCTATCCAATATGAAAATGATGACATTATGCGTGAAAGC
TATGGCGATGACTATGGTATCGCATGTTGTGTATCAGCGATGACAATTGGTAAAC
AAATGCAATTCTTCGGTGCACGTGCGAACTTAGCTAAAACATTACTTTACGCTATC
AATGGTGGTAAAGATGAAAAATCTGGTGCACAAGTTGGTCCAAACTTCGAAGGTA
TTAACAGCGAAGTATTAGAATATGACGAAGTATTCAAGAAATTTGATCAAATGAT
GGATTGGCTAGCAGGTGTTTACATTAACTCATTAAATGTTATTCACTACATGCACG
ATAAATACAGCTATGAACGTATTGAAATGGCATTACATGATACAGAAATTGTACG
TACAATGGCAACAGGTATCGCTGGTTTATCAGTAGCAGCTGACTCATTATCTGCAA
TTAAATATGCACAAGTTAAACCAATTCGTAACGAAGAAGGTCTTGTAGTAGACTT
TGAAATCGAAGGCGACTTCCCTAAATACGGTAACAATGACGACCGTGTAGATGAT
ATTGCAGTTGATTTAGTAGAACGCTTCATGACTAAATTACGTAGTCATAAAACATA
TCGTGATTCAGAACATACAATGAGTGTATTAACAATTACTTCAAACGTTGTATACG
GTAAGAAACTGGTAACACACCAGACGGACGTAAAGCTGGCGAACCATTTGCTCC
AGGTGCAAACCCAATGCATGGCCGTGACCAAAAGGTGCATTATCTTCATTAAGT
TCTGTAGCTAAGATCCCTTACGATTGCTGTAAAGATGGTATTTCAAATACATTCAG
TATCGTACCAAAATCATTAGGTAAAGAACCAGAAGATCAAACCGTAACTTAACT
AGTATGTTAGATGGTTACGCAATGCAATGTGGTCACCACTTAAATATTAACGTATT
TAACCGTGAAACATTAATAGATGCAATGGAACATCCAGAAGAATATCCACAGTTA
ACAATCCGTGTATCTGGTTACGCTGTTAACTTCATTAAATTAACACGTGAACAACA
ATTAGATGTAATTTCTCGTACATTCCATGAAAGTATGTAA
(SEQ ID NO:439)

Figure 94

ATGTTAGAAACAAATAAAAATCATGCAACAGCTTGGCAAGGATTTAAAAATGGA
AGATGGAACAGACACGTAGATGTAAGAGAGTTTATCCAATTAAACTACACTCTTT
ATGAAGGTAATGATTCATTTTTAGCAGGACCAACAGAAGCAACTTCTAAACTTTG
GGAACAAGTAATGCAGTTATCGAAAGAAGAACGTGAACGTGGCGGCATGTGGGA
TATGGACACGAAAGTAGCTTCAACAATCACATCTCATGATGCTGGTTATTTAGAC
AAAGATTTAGAAACAATTGTAGGTGTACAAACTGAAAAGCCATTCAAACGTTCAA
TGCAACCATTCGGTGGTATTCGTATGGCGAAAGCAGCTTGTGAAGCTTACGGTTA
CGAATTAGACGAAGAAACTGAAAAAATCTTTACAGATTATCGTAAAACACATAAC
CAAGGTGTATTCGATGCATATTCTAGAGAAATGTTGAACTGCCGTAAAGCAGGTG
TAATCACTGGTTTACCTGATGCATACGGACGTGGACGTATTATCGGTGACTATCGT
CGTGTAGCTTTATATGGTGTAGATTTCTTAATGGAAGAAAAATGCACGACTTCA
ACACGATGTCTACAGAAATGTCAGAAGATGTAATTCGTTTACGTGAAGAATTATC
AGAACAATATCGTGCATTAAAAGAATTAAAGAACTTGGACAAAATATGGTTTC
GATTTAAGCCGTCCAGCAGAAAACTTCAAAGAAGCAGTTCAATGGTTATACTTAG
CATACCTTGCTGCAATTAAAGAACAAAACGGTGCAGCAATGAGTTTAGGTCGTAC
ATCAACATTCTTAGATATCTATGCTGAACGTGACCTTAAAGCAGGCGTTATTACTG
AAAGCGAAGTTCAAGAAATTATTGACCACTTCATCATGAAATTACGTATTGTTAA
ATTTGCTCGTACACCTGATTACAATGAATTATTCTCTGGAGACCCAACTTGGGTAA
CTGAATCTATCGGTGGTGTAGGTATTGACGGACGTCCACTTGTTACGAAAAACTC
ATTCCGTTTCTTACACTCATTAGATAACTTAGGTCCAGCTCCAGAACCAAACTTAA
CAGTATTATGGTCAGTACGTTTACCTGACAACTTCAAAACATACTGTGCAAAAAT
GAGTATTAAAACAAGTTCTATCCAATATGAAAATGATGACATTATGCGTGAAAGC
TATGGCGATGACTATGGTATCGCATGTTGTGTATCAGCGATGACAATTGGTAAAC
AAATGCAATTCTTCGGTGCACGTGCGAACTTAGCTAAAACATTACTTTACGCTATC
AATGGTGGTAAAGATGAAAAATCTGGTGCACAAGTTGGTCCAAACTTCGAAGGTA
TTAACAGCGAAGTATTAGAATATGACGAAGTATTCAAGAAATTTGATCAAATGAT
GGATTGGCTAGCAGGTGTTTACATTAACTCATTAAATGTTATTCACTACATGCACG
ATAAATACAGCTATGAACGTATTGAAATGGCATTACATGATACAGAAATTGTACG
TACAATGGCAACAGGTATCGCTGGTTTATCAGTAGCAGCTGACTCATTATCTGCAA
TTAAATATGCACAAGTTAAACCAATTCGTAACGAAGAAGGTCTTGTAGTAGACTT
TGAAATCGAAGGCGACTTCCCTAAATACGGTAACAATGACGACCGTGTAGATGAT
ATCGCAGTTGATTTAGTAGAACGCTTTATGACTAAATTACGTAGTCATAAACATA
TCGTGATTCAGAACATACAATGAGTGTATTAACAATTACTTCAAACGTTGTATACG
GTAAGAAAACTGGTAACACACCAGACGGACGTAAAGCTGGCGAACCATTTGCAC
CAGGTGCAAACCCAATGCATGGCCGTGACCAAAAAGGTGCATTATCTTCATTAAG
TTCTGTAGCTAAGATCCCTTACGATTGCTGTAAAGATGGTATTTCAAATACATTCA
GTATCGTACCAAAATCATTAGGTAAAGAACCAGAAGATCAAACCGTAACTTAAC
TAGTATGTTAGATGGTTACGCAATGCAATGTGGTCACCACTTAAATATTAACGTAT
TTAACCGTGAAACATTAATAGATGCAATGGAACATCCAGAAGAATATCCACAGTT
AACAATCCGTGTATCTGGTTACGCTGTTAACTTCATTAAATTAACACGTGAACAAC
AATTAGATGTAATTTCTCGTACATTCCATGAAAGTATGTAA
(SEQ ID NO:440)

Figure 95

AAAAAAGAAAACAAGCAATTAACGTATACGACGGTTAAAGATATCGGGGATA
TGAACCCGCATGTTTACGGTGGATCGATGTCTGCTGAAAGTATGATATACGAG
CCGCTTGTACGTAACACGAAAGACGGGATTAAGCCTTTACTAGCTAAAAAATG
GGGTGTGTCTGAAGATGGGAAGACATACACGTTCCATTTGAGAGATGACGTTA
AATTCCATGATGGTACGCCATTTGATGCTGACGCAGTTAAGAAAAATATTGAC
GCAGTTCAAGAAACAAAAAATTGCATTCTTGGTTAAAGATTTCAACATTAAT
TGACAATGTTAAAGTTAAAGATAAGTACACGGTTGAATTGAATTTGAAAGAA
GCATATCAACCTGCATTGGCTGAATTAGCGATGCCTCGTCCATATGTATTTGTG
TCTCCAAAAGACTTTAAAAACGGCACAACAAAGATGGCGTTAAAAAGTTCG
ATGGTACTGGTCCGTTTAAATTAGGTGAACACAAAAAAGATGAGTCTGCAGAC
TTTAACAAAATGATCAATACTGGGGCGAAAAGTCTAAACTTAACAAAGTAC
AAGCAAAGTAATGCCTGCTGGTGAAACAGCATTCCTATCAATGAAAAAGG
TGAAACGAACTTTGCCTTCACAGATGATGGAGGTACAGATAGCTTAGACAAA
GACTCTTTAAAACAATTGAAAGATACTGGTGACTATCAAGTTAAGCGTAGTCA
ACCTATGAATACGAAAATGTTAGTTGTCAATTCTGGTAAAAAGATAACGCTG
TCAGTGACAAAACAGTCAGACAAGCGATTGGTCATATGGTAAACAGAGATAA
AATTGCCAAAGAAATTTTAGATGGTCAAGAAAACCAGCAACTCAATTATTTG
CGAAAAATGTAACAGACATTAATTTCGATATGCCAACACGTAAGTATGACCTT
AAAAAAGCAGAATCATTATTAGATGAAGCTGGTTGGAAGAAAGGTAAAGACA
GCGATGTTCGTCAAAAGATGGTAAAAACCTTGAAATGGCAATGTACTATGAC
AAAGGTTCTTCAAGTCAAAAGAACAAGCAGAATACTTACAAGCAGAATTTA
AGAAAATGGGTATTAAGTTAAACATCAATGGCGAAACATCAGATAAAATTGC
TGAACGTCGTACTTCTGGTGATTATGACTTAATGTTCAACCAAACTTGGGGATT
ATTGTACGATCCACAAAGTACTATTGCAGCATTTAAAGCGAAAAATGGTATGA
AAGTGCAACATCAGGCATTGAGAATAAAGATAAAATATACAACAGCATTGAT
GACGCATTTAAAATCCAAAACGGTAAAGAGCGTTCAGACGCTTATAAAAACA
TTTTGAAACAAGTTGATGATGAAGGTATCTTTATCCCTGTTTCACACGGTAGTA
TGACAGTTGTTGCGCCGAAAGATTTAGAAAAGTATCATTCACACAATCACAG
TACGAATTACCATTCAATGAAATGCAGTATAAATAA
(SEQ ID NO:441)

Figure 96

ATGAGAAAACTAACTAAAATGAGTGCAATGTTACTTGCATCAGGGCTAATTTT
AACTGGTTGTGGCGGTAATAAAGGTTTAGAGGAGAAAAAGAAAACAAGCAA
TTAACGTATACGACGGTTAAAGATATCGGGGATATGAACCCGCATGTTTACGG
TGGATCGATGTCTGCTGAAAGTATGATATACGAGCCACTTGTACGTAACACGA
AAGATGGGATTAAGCCTTTATTAGCTAAAAATGGGATGTTTCTGAAGATGGG
AAGACATATACATTCCATTTGAGAGATGACGTTAAATTCCATGATGGTACGCC
ATTTGATGCTGACGCAGTTAAGAAAATATTGACGCGGTTCAAGAAAACAAA
AAATTGCATTCTTGGTTAAAGATTTCAACATTAATTGACAATGTTAAAGTTAA
AGATAAGTACACGGTTGAATTGAATTTGAAAGAAGCATATCAACCTGCATTGG
CTGAATTAGCGATGCCTCGTCCATATGTATTTGTGTCTCCAAAAGACTTTAAAA
ACGGCACAACAAAAGATGGCGTTAAAAAGTTCGATGGTACTGGTCCATTTAA
ATTAGGTGAACACAAAAAAGATGAGTCTGCAGACTTTAACAAAAATGATCAA
TACTGGGGCGAAAAGTCTAAACTTAACAAAGTACAAGCAAAAGTAATGCCTG
CTGGTGAAACAGCATTCCTATCAATGAAAAAGGTGAAACGAACTTTGCCTTC
ACAGATGATAGAGGTACAGATAGCTTAGACAAAGACTCTTTAAAACAATTGA
AAGATACAGGTGACTATCAAGTTAAGCGTAGTCAACCTATGAATACGAAAAT
GTTAGTTGTCAATTCTGGTAAAAAGATAGCGCTGTCAGTGACAAAACAGTCA
GACAAGCGATTGGTCATATGGTAAACAGAGATAAAATTGCCAAAGAAATTTT
AGATGGTCAAGAAAAACCAGCAACTCAATTATTTGCGAAAAATGTAACAGAC
ATTAATTTCGATATGCCAACACGTAAGTATGACCTTAAAAAAGCAGAATCATT
ATTAGATGAAGCTGGTTGGAAGAAAGGTAAAGACAGCGATGTTCGTCAAAAA
GATGGTAAAAACCTTGAAATGGCAATGTACTATGACAAAGGTTCTTCAAGTCA
AAAAGAACAAGCAGAATACTTACAAGCAGAATTTAAGAAAATGGGTATTAAG
TTAAACATCAATGGCGAAACATCAGATAAAATTGCTGAACGTCGTACTTCTGG
TGATTATGACTTAATGTTCAACCAAACTTGGGGATTATTGTACGATCCACAAA
GTACTATTGCAGCATTTAAAGCGAAAAATGGTTATGAAAGTGCAACATCAGGC
ATTGAGAATAAAGATAAAATATACAACAGCATTGATGACGCATTTAAAATCC
AAAACGGTAAAGAGCGTTCAGACGCTTATAAAACATTTTGAAACAAGTTAA
TGATGAAGGTATCTTTATCCCTATTTCACACGGTAGTATGACAGTTGTTGCGCC
GAAAGATTTAGAAAAGTATCATTCACACAATCACAGTATGAATTACCATTCA
ATGAAATGCAGTATAAATAA
(SEQ ID NO:442)

Figure 97

ATGAGAAAACTAACTAAAATGAGTGCAATGTTACTTGCATCAGGGCTAATTTT
AACTGGTTGTGGCGGTAATAAAGGTTTAGAGGAGAAAAAAGAAAACAAGCAA
TTAACGTATACGACGGTTAAAGATATCGGTGATATGAATCCGCATGTTTACGG
TGGATCAATGTCTGCTGAAAGTATGATATACGAGCCGCTTGTACGTAACACGA
AAGATGGTATTAAGCCTTTACTAGCTAAAAATGGGATGTGTCTGAAGATGGG
AAGACTTATACATTCCATTTAAGAGATGATGTGAAATTCCATGATGGAACAAC
ATTTGATGCTGACGCAGTTAAGAAAATATTGATGCGGTTCAACAAAATAAAA
AATTGCATTCTTGGTTAAAGATTTCAACATTAATTGACAATGTTAAAGTTAAA
GATAAGTACACGGTTGAATTGAATTTGAAAGAAGCATATCAACCTGCATTGGC
TGAATTAGCGATGCCTCGTCCATATGTATTTGTGTCTCCAAAAGACTTTAAAA
ACGGTACAACAAAAGATGGCGTTAAAAAGTTCGATGGTACTGGTCCATTTAAA
TTAGGTGAACACAAAAAAGATGAGTCTGCAGACTTTAACAAAAATGATCAAT
ACTGGGGCGAAAAGTCTAAACTTAACAAAGTACAAGCAAAAGTAATGCCTGC
TGGTGAAACAGCATTCCTATCAATGAAAAAGGTGAAACGAACTTTGCCTTCA
CAGATGATAGAGGTACGGATAGCTTAGACAAAGACTCTTTAAAACAATTGAA
AGATACAGGTGACTATCAAGTTAAGCGTAGTCAACCTATGAATACGAAAATGT
TAGTTGTCAATTCTGGTAAAAAGATAACGCTGTCAGTGACAAAACAGTCAGA
CAAGCGATTGGTCATATGGTAAACAGAGATAAAATTGCCAAAGAAATTTTAG
ATGGTCAAGAAAAACCAGCAACTCAATTATTTGCGAAAAATGTAACAGACAT
TAATTTCGATATGCCAACACGTAAGTATGACCTTAAAAAAGCAGAATCATTAT
TAGATGAAGCTGGTTGGAAGAAAGGTAAAGACAGTGATGTTCGTCAAAAAGA
TGGTAAAAACCTTGAAATGGCAATGTACTATGACAAAGGTTCTTCAAGTCAAA
AAGAACAAGCAGAATACTTACAAGCAGAATTTAAGAAAATGGGTATTAAGTT
AAACATCAATGGCGAAACATCAGATAAAATTGCTGAACGTCGTACTTCTGGTG
ATTATGACTTAATGTTCAACCAAACTTGGGGATTATTGTACGATCCACAAAGT
ACTATTGCAGCATTTAAAGCGAAAAATGGTTATGAAAGTGCAACATCAGGCAT
TGAGAACAAAGATAAAATATACAACAGCATTGATGACGCATTTAAAATCCAA
AACGGTAAAGAGCGTTCAGACGCTTATAAAACATTTTGAAACAAATTGATG
ATGAAGGTATCTTTATCCCTATTTCACACGGTAGTATGACAGTTGTTGCGCCGA
AAGATTTAGAAAAGTATCATTCACACAATCACAGTATGAATTACCATTCAAT
GAAATGCAGTATAAATAA (SEQ ID NO:443)

Figure 98

ATGAGAAAACTAACTAAAATGAGTGCAATGTTACTTGCATCAGGGCTAATTTT
AACTGGTTGTGGCGGTAATAAAGGTTTAGAGGAGAAAAAAGAAAACAAGCAA
TTAACGTATACGACGGTTAAAGATATCGGGGATATGAATCCGCATGTTTACGG
TGGATCGATGTCTGCTGAAAGTATGATATACGAGCCGCTTGTACGTAACACGA
AAGATGGGATTAAGCCTTTACTAGCTAAAAATGGGATGTGTCAGAAGATGG
GAAGACATACACGTTCCATTTGAGAGATGACGTTAAATTCCATGATGGTACGC
CATTTGATGCTGACGCAGTTAAGAAAATATTGACGCAGTTCAAGAAAACAA
AAAATTGCATTCTTGGTTAAAGATTTCAACATTAATTGACAATGTTAAAGTTA
AAGATAAGTACACGGTTGAATTAAATTTGAAAGAAGCATATCAACCTGCATTG
GCTGAATTAGCGATGCCTCGTCCATATGTATTTGTATCTCCAAAAGACTTTAAA
AACGGCACAACAAAAGATGGCGTTAAAAAGTTCGATGGTACTGGTCCATTTA
AATTAGGTGAACACAAAAAAGATGAGTCTGCAGACTTTAATAAAAATGATCA
ATACTGGGGCGAAAAGTCTAAACTTAACAAAGTACAAGCAAAGTAATGCCT
GCTGGTGAAACAGCATTCCTATCAATGAAAAAGGTGAAACAAACTTTGCCTT
CACAGACGATAGAGGTACAGATAGCTTAGACAAAGACTCTTTAAAACAATTG
AAAGATACAGGTGACTATCAAGTTAAGCGTAGTCAACCTATGAATACGAAAA
TGTTAGTGGTCAATTCTGGTAAAAAGATAACGCTGTCAGTGACAAAACAGTC
AGACAAGCGATTGGTCATATGGTAAACAGAGATAAAATTGCCAAAGAAATTT
TAGATGGTCAAGAAAAACCAGCAACTCAATTATTTGCGAAAAATGTAACAGA
CATTAATTTCGATATGCCAACACGTAAGTATGACCTTAAAAAAGCAGAATCAT
TATTAGATGAAGCTGGTTGGAAGAAAGGTAAAGACAGCGATGTTCGTCAAAA
AGATGGTAAAAACCTTGAAATGGCAATGTACTATGACAAAGGTTCTTCAAGTC
AAAAAGAACAAGCAGAATACTTACAAGCAGAATTTAAGAAATGGGTATTAA
GTTAAACATCAATGGCGAAACATCAGATAAAATTGCTGAACGTCGTACTTCTG
GTGATTATGACTTAATGTTCAACCAAACTTGGGGATTATTGTACGATCCACAA
AGTACTATTGCAGCATTTAAAGCGAAAAATGGTTATGAAAGTGCAACATCAG
GCATTGAGAACAAAGATAAATATACAACAGCATTGATGACGCATTTAAAAT
CCAAAACGGTAAAGAGCGTTCAGACGCTTATAAAAACATTTTGAAACAAATT
GATGATGAAGGTATTTTTATCCCTATTTCACACGGTAGTATGACAGTTGTTGCG
CCGAAAGATTTAGAAAAGTAGCATTCACACAATCACAGTATGAATTACCATT
CAATGAAATGCAGTATAAATAA (SEQ ID NO:444)

Figure 99

ATGAGAAAACTAACTAAAATGAGTGCAATGTTACTTGCATCAGGGCTAATTTT
AACTGGTTGTGGCGGTAATAAAGGTTTAGAGGAGAAAAAAGAAAACAAGCAA
TTAACGTATACGACGGTTAAAGATATCGGTGATATGAATCCGCATGTTTACGG
TGGATCGATGTCTGCTGAAAGTATGATATACGAGCCGCTTGTACGTAACACGA
AAGATGGAATTAAGCCTTTACTAGCTAAAAAATGGGATGTGTCTGAAGATGG
GAAGACATATACATTCCATTTGAGAGATGACGTTAAATTCCATGATGGTACAC
CATTTGATGCTGACGCAGTTAAGAAAATATTGATGCGGTTCAACAAAATAAA
AAATTGCATTCTTGGTTAAAGATTTCAACATTAATTGACAATGTTAAAGTTAA
AGATAAGTACACGGTTGAATTGAATTTGAAAGAAGCATATCAACCTGCATTGG
CTGAATTAGCGATGCCTCGTCCATATGTATTTGTGTCTCCAAAAGACTTTAAAA
ACGGTACAACAAAAGATGGCGTTAAAAAGTTCGATGGTACTGGTCCATTTAAA
TTAGGTGAACATAAAAAAGATGAGTCTGCAGACTTTAACAAAAATGATCAAT
ACTGGGGCGAAAAGTCTAAACTTAACAAAGTACAAGCAAAGTAATGCCTGC
TGGTGAAACAGCATTCCTATCAATGAAAAAGGTGAAACGAACTTTGCCTTCA
CAGATGATAGAGGTACGGATAGCTTAGACAAAGACTCTTTAAAACAATTGAA
AGATACAGGTGACTATCAAGTTAAGCGTAGTCAACCTATGAATACGAAAATGT
TAGTTGTCAATTCTGGTAAAAAGATAACGCTGTGAGTGACAAAACAGTCAG
ACAAGCGATTGGTCATATGGTAAACAGAGATAAAATTGCCAAAGAAATTTTA
GATGGTCAAGAAAAACCAGCAACTCAATTATTTGCGAAAAATGTAACAGATA
TTAATTTCGATATGCCAACACGTAAGTATGACCTTAAAAAAGCAGAATCATTA
TTAGATGAAGCTGGTTGGAAGAAAGGTAAAGACAGCGATGTTCGTCAAAAAG
ATGGTAAAAACCTTGAAATGGCAATGTACTATGACAAAGGTTCTTCAAGTCAA
AAAGAACAAGCAGAATACTTACAAGCAGAATTTAAGAAAATGGGTATTAAGT
TAAACATCAATGGCGAAACATCAGATAAAATTGCTGAACGTCGTACTTCTGGT
GATTATGACTTAATGTTCAACCAAACTTGGGGATTATTGTACGATCCACAAAG
TACTATTGCAGCATTTAAAGCGAAAAATGGTTATGAAAGTGCAACATCAGGCA
TTGAGAACAAAGATAAAATATACAACAGCATTGATGACGCATTTAAAATCCA
AAACGGTAAAGAGCGTTCAGGCGCTTATAAAACATTTTGAAACAAATTGAT
GATGAAGGTATCTTTATCCCTATTTCACACGGTAGTATGACAGTTGTTGCGCCG
AAAGATTTAGAAAAGTATCATTCACACAATCACAGTATGAATTACCATTCAA
TGAAATGCAGTATAAATAA
(SEQ ID NO:445)

Figure 100

ATGAGAAAACTAACTAAAATGAGTGCAATGTTACTTGCATCAGGGCTAATTTT
AACTGGTTGTGGCGGTAATAAAGGTTTAGAGGAGAAAAAGAAAACAAGCAA
TTAACGTATACGACGGTTAAAGATATCGGTGATATGAATCCGCATGTTTACGG
TGGATCAATGTCTGCTGAAAGTATGATATACGAGCCGCTTGTACGTAACACGA
AAGATGGTATTAAGCCTTTACTAGCTAAAAAGTGGGATGTGTCTGAAGATGGG
AAGACATACACGTTCCATTTGAGAGATGACGTTAAATTCCATGATGGTACGCC
ATTTGATGCTGACGCAGTTAAGAAAATATTGACGCAGTTCAAGAAAACAAA
AAATTGCATTCTTGGTTAAAGATTTCGACATTAATTGACAATGTTAAAGTTAA
AGATAAGTACACGGTTGAATTGAATTTGAAAGAAGCATATCAACCTGCATTGG
CTGAATTAGCGATGCCTCGTCCATATGTATTTGTGTCTCCAAAAGACTTTAAAA
ACGGTACAACAAAAGATGGCGTTAAAAAGTTCGATGGTACTGGTCCATTTAAA
TTAGGTGAACACAAAAAAGATGAGTCTGCAGACTTTAACAAAAATGATCAAT
ACTGGGGCGAAAAGTCTAAACTTAACAAAGTACAAGCAAAAGTAATGCCTGC
TGGTGAAACAGCATTCCTATCAATGAAAAAGGTGAAACGAACTTTGCCTTCA
CAGATGATAGAGGTACAGATAGCTTAGACAAAGACTCTTTAAAACAATTGAA
AGATACAGGTGACTATCAAGTTAAGCGTAGTCAACCTATGAATACGAAAATGT
TAGTTGTCAATTCTGGTAAAAAGATAACGCTGTGAGTGACAAAACAGTCAG
ACAAGCGATTGGTCATATGGTAAACAGAGATAAAATTGCCAAAGAAATTTA
GATGGTCAAGAAAAACCAGCAACTCAATTATTTGCGAAAAATGTAACAGACA
TTAATTTCGATATGCCAACACGTAAGTATGACCTTAAAAAAGCAGAATCATTA
TTAGATGAAGCTGGTTGGAAGAAAGGTAAAGACAGCGATGTTCGTCAAAAAG
ATGGTAAAAACCTTGAAATGGCAATGTACTATGACAAAGGTTCTTCAAGTCAA
AAAGAACAAGCAGAATACTTACAAGCAGAATTTAAGAAATGGGTATTAAGT
TAAACATCAATGGCGAAACATCAGATAAAATTGCTGAACGTCGTACTTCTGGT
GATTATGACTTAATGTTCAACCAAACTTGGGGATTATTGTACGATCCACAAAG
TACTATTGCAGCATTTAAAGCGAAAAATGGTTATGAAAGTGCAACATCAGGCA
TTGAGAACAAAGATAAAATATACAACAGCATTGATGACGCATTTAAAATCCA
AAACGGTAAAGAGCGTTCAGACGCTTATAAAACATTTTGAAACAAATTGAT
GATGAAGGTATCTTTATCCCTATTTCACACGGTAGTATGACAGTTGTTGCACCA
AAAGATTTAGAAAAGTATCATTCACACAATCACAGTATGAATTACCATTCAA
TGAAATGCAGTATAAATAA
(SEQ ID NO:446)

Figure 101

ATGAGAAAACTAACTAAAATGAGTGCAATGTTACTTGCATCAGGGCTAATTTT
AACTGGTTGTGGCGGTAATAAAGGTTTAGAGGAGAAAAAGAAAACAAGCAA
TTAACGTATACGACGGTTAAAGATATCGGTGATATGAATCCGCATGTTTACGG
TGGATCAATGTCTGCTGAAAGTATGATATACGAGCCGCTTGTACGTAACACGA
AAGATGGTATTAAGCCTTTACTAGCTAAAAAATGGGATGTGTCTGAAGATGGG
AAGACTTATACATTCCATTTAAGAGATGATGTGAAATTCCATGATGGAACAAC
ATTTGATGCTGACGCAGTTAAGAAAAATATTGATGCGGTTCAACAAAATAAAA
AATTGCATTCTTGGTTAAAGATTTCAACATTAATTGACAATGTTAAAGTTAAA
GATAAGTACACGGTTGAATTGAATTTGAAAGAAGCATATCAACCTGCATTGGC
TGAATTAGCGATGCCTCGTCCATATGTATTTGTGTCTCCAAAAGACTTTAAAA
ACGGTACAACAAAAGATGGCGTTAAAAAGTTCGATGGTACTGGTCCATTTAAA
TTAGGTGAACACAAAAAAGATGAGTCTGCAGACTTTAACAAAAATGATCAAT
ACTGGGGCGAAAAGTCTAAACTTAACAAAGTACAAGCAAAAGTAATGCCTGC
TGGTGAAACAGCATTCCTATCAATGAAAAAGGTGAAACGAACTTTGCCTTCA
CAGATGATAGAGGTACGGATAGCTTAGACAAAGACTCTTTAAAACAATTGAA
AGATACAGGTGACTATCAAGTTAAGCGTAGTCAACCTATGAATACGAAAATGT
TAGTTGTCAATTCTGGTAAAAAGATAACGCTGTCAGTGACAAAACAGTCAGA
CAAGCGATTGGTCATATGGTAAACAGAGATAAAATTGCCAAAGAAATTTTAG
ATGGTCAAGAAAAACCAGCAACTCAATTATTTGCGAAAAATGTAACAGACAT
TAATTTCGATATGCCAACACGTAAGTATGACCTTAAAAAAGCAGAATCATTAT
TAGATGAAGCTGGTTGGAAGAAAGGTAAAGACAGTGATGTTCGTCAAAAAGA
TGGTAAAAACCTTGAAATGGCAATGTACTATGACAAAGGTTCTTCAAGTCAAA
AAGAACAAGCAGAATACTTACAAGCAGAATTTAAGAAAATGGGTATTAAGTT
AAACATCAATGGCGAAACATCAGATAAAATTGCTGAACGTCGTACTTCTGGTG
ATTATGACTTAATGTTCAACCAAACTTGGGGATTATTGTACGATCCACAAAGT
ACTATTGCAGCATTTAAAGCGAAAAATGGTTATGAAAGTGCAACATCAGGCAT
TGAGAACAAAGATAAAATATACAACAGCATTGATGACGCATTTAAAATCCAA
AACGGTAAAGAGCGTTCAGACGCTTATAAAACATTTTGAAACAAATTGATG
ATGAAGGTATCTTTATCCCTATTTCACACGGTAGTATGACAGTTGTTGCGCCGA
AAGATTTAGAAAAAGTATCATTCACACAATCACAGTATGAATTACCATTCAAT
GAAATGCAGTATAAATAA (SEQ ID NO:447)

Figure 102

ATGAGAAAACTAACTAAAATGAGTGCAATGTTACTTGCATCAGGGCTAATTTT
AACTGGTTGTGGCGGTAATAAAGGTTTAGAGGAGAAAAAGAAAACAAGCAA
TTAACGTATACGACGGTTAAAGATATCGGTGATATGAATCCGCATGTTTACGG
TGGATCAATGTCTGCTGAAAGTATGATATACGAGCCGCTTGTACGTAACACGA
AAGATGGTATTAAGCCTTTACTAGCTAAAAAGTGGGATGTGTCTGAAGATGGG
AAGACATACACGTTCCATTTGAGAGATGACGTTAAATTCCATGATGGTACGCC
ATTTGATGCTGACGCAGTTAAGAAAATATTGACGCAGTTCAAGAAAACAAA
AAATTGCATTCTTGGTTAAAGATTTCGACATTAATTGACAATGTTAAAGTTAA
AGATAAGTACACGGTTGAATTGAATTTGAAAGAAGCATATCAACCTGCATTGG
CTGAATTAGCGATGCCTCGTCCATATGTATTTGTGTCTCCAAAAGACTTTAAAA
ACGGTACAACAAAAGATGGCGTTAAAAAGTTCGATGGTACTGGTCCATTTAAA
TTAGGTGAACACAAAAAGATGAGTCTGCAGACTTTAACAAAAATGATCAAT
ACTGGGGCGAAAAGTCTAAACTTAACAAAGTACAAGCAAAAGTAATGCCTGC
TGGTGAAACAGCATTCCTATCAATGAAAAAGGTGAAACGAACTTTGCCTTCA
CAGATGATAGAGGTACAGATAGCTTAGACAAAGACTCTTTAAAACAATTGAA
AGATACAGGTGACTATCAAGTTAAGCGTAGTCAACCTATGAATACGAAAATGT
TAGTTGTCAATTCTGGTAAAAAGATAACGCTGTGAGTGACAAAACAGTCAG
ACAAGCGATTGGTCATATGGTAAACAGAGATAAAATTGCCAAAGAAATTTA
GATGGTCAAGAAAAACCAGCAACTCAATTATTTGCGAAAAATGTAACAGACA
TTAATTTCGATATGCCAACACGTAAGTATGACCTTAAAAAAGCAGAATCATTA
TTAGATGAAGCTGGTTGGAAGAAAGGTAAAGACAGCGATGTTCGTCAAAAAG
ATGGTAAAAACCTTGAAATGGCAATGTACTATGACAAAGGTTCTTCAAGTCAA
AAAGAACAAGCAGAATACTTACAAGCAGAATTTAAGAAATGGGTATTAAGT
TAAACATCAATGGCGAAACATCAGATAAAATTGCTGAACGTCGTACTTCTGGT
GATTATGACTTAATGTTCAACCAAACTTGGGGATTATTGTACGATCCACAAAG
TACTATTGCAGCATTTAAAGCGAAAAATGGTTATGAAAGTGCAACATCAGGCA
TTGAGAACAAAGATAAAATATACAACAGCATTGATGACGCATTTAAAATCCA
AAACGGTAAAGAGCGTTCAGACGCTTATAAAACATTTTGAAACAAATTGAT
GATGAAGGTATCTTTATCCCTATTTCACACGGTAGTATGACAGTTGTTGCACCA
AAAGATTTAGAAAAGTATCATTCACACAATCACAGTATGAATTACCATTCAA
TGAAATGCAGTATAAATAA
(SEQ ID NO:448)

Figure 103

ATGAGAAACTAACTAAAATGAGTGCAATGTTACTTACATCAGGGCTAATTTT
AACTGGTTGTGGCGGTAATAAAGGTTTAGAGGAGAAAAAGAAAACAAGCAA
TTAACGTATACGACGGTTAAAGATATCGGTGATATGAATCCGCATGTTTACGG
TGGATCAATGTCTGCTGAAAGTATGATATACGAGCCGCTTGTACGTAACACGA
AAGATGGTATTAAGCCTTTACTAGCTAAAAGTGGGATGTGTCTGAAGATGGG
AAGACATACACGTTCCATTTGAGAGATGACGTTAAATTCCATGATGGTACGCC
ATTTGATGCTGACGCAGTTAAGAAAATATTGACGCAGTTCAAGAAAACAAA
AAATTGCATTCTTGGTTAAAGATTTCGACATTAATTGACAATGTTAAAGTTAA
AGATAAGTACACGGTTGAATTGAATTTGAAAGAAGCATATCAACCTGCATTGG
CTGAATTAGCGATGCCTCGTCCATATGTATTTGTGTCTCCAAAAGACTTTAAAA
ACGGTACAACAAAAGATGGCGTTAAAAAGTTCGATGGTACTGGTCCATTTAAA
TTAGGTGAACACAAAAAAGATGAGTCTGCAGACTTTAACAAAAATGATCAAT
ACTGGGGCGAAAAGTCTAAACTTAACAAAGTACAAGCAAAAGTAATGCCTGC
TGGTGAAACAGCATTCCTATCAATGAAAAAGGTGAAACGAACTTTGCCTTCA
CAGATGATAGAGGTACAGATAGCTTAGACAAAGACTCTTTAAAACAATTGAA
AGATACAGGTGACTATCAAGTTAAGCGTAGTCAACCTATGAATACGAAAATGT
TAGTTGTCAATTCTGGTAAAAAAGATAACGCTGTGAGTGACAAAACAGTCAG
ACAAGCGATTGGTCATATGGTAAACAGAGATAAAATTGCCAAAGAAATTTTA
GATGGTCAAGAAAAACCAGCAACTCAATTATTTGCGAAAAATGTAACAGACA
TTAATTTCGATATGCCAACACGTAAGTATGACCTTAAAAAGCAGAATCATTA
TTAGATGAAGCTGGTTGGAAGAAAGGTAAAGACAGCGATGTTCGTCAAAAAG
ATGGTAAAAACCTTGAAATGGCAATGTACTATGACAAAGGTTCTTCAAGTCAA
AAAGAACAAGCAGAATACTTACAAGCAGAATTTAAGAAAATGGGTATTAAGT
TAAACATCAATGGCGAAACATCAGATAAAATTGCTGAACGTCGTACTTCTGGT
GATTATGACTTAATGTTCAACCAAACTTGGGGATTATTGTACGATCCACAAAG
TACTATTGCAGCATTTAAAGCGAAAAATGGTTATGAAAGTGCAACATCAGGCA
TTGAGAACAAAGATAAAATATACAACAGCATTGATGACGCATTTAAAATCCA
AAACGGTAAAGAGCGTTCAGACGCTTATAAAACATTTTGAAACAAATTGAT
GATGAAGGTATCTTTATCCCTATTTCACACGGTAGTATGACAGTTGTTGCACCA
AAAGATTTAGAAAAGTATCATTCACACAATCACAGTATGAATTACCATTCAA
TGAAATGCAGTATAAATAA
(SEQ ID NO:449)

Figure 104

ATGAGAAAACTAACTAAAATGAGTGCAATGTTACTTGCATCAGGGCTAATTTT
AACTGGTTGTGGCGGTAATAAAGGTTTAGAGGAGAAAAAAGAAAACAAGCAA
TTAACGTATACGACGGTTAAAGATATCGGTGATATGAATCCGCATGTTTACGG
TGGATCAATGTCTGCTGAAAGTATGATATACGAGCCGCTTGTACGTAACACGA
AAGATGGTATTAAGCCTTTACTAGCTAAAAGTGGGATGTGTCTGAAGATGGG
AAGACATACACGTTCCATTTGAGAGATGACGTTAAATTCCATGATGGTACGCC
ATTTGATGCTGACGCAGTTAAGAAAATATTGACGCAGTTCAAGAAAACAAA
AAATTGCATTCTTGGTTAAAGATTTCGACATTAATTGACAATGTTAAAGTTAA
AGATAAGTACACGGTTGAATTGAATTTGAAAGAAGCATATCAACCTGCATTGG
CTGAATTAGCGATGCCTCGTCCATATGTATTTGTGTCTCCAAAAGACTTTAAAA
ACGGTACAACAAAAGATGGCGTTAAAAAGTTCGATGGTACTGGTCCATTTAAA
TTAGGTGAACACAAAAAAGATGAGTCTGCAGACTTTAACAAAAATGATCAAT
ACTGGGGCGAAAAGTCTAAACTTAACAAAGTACAAGCAAAAGTAATGCCTGC
TGGTGAAACAGCATTCCTATCAATGAAAAAGGTGAAACGAACTTTGCCTTCA
CAGATGATAGAGGTACAGATAGCTTAGACAAAGACTCTTTAAAACAATTGAA
AGATACAGGTGACTATCAAGTTAAGCGTAGTCAACCTATGAATACGAAAATGT
TAGTTGTCAATTCTGGTAAAAAGATAACGCTGTGAGTGACAAAACAGTCAG
ACAAGCGATTGGTCATATGGTAAACAGAGATAAAATTGCCAAAGAAATTTA
GATGGTCAAGAAAAACCAGCAACTCAATTATTTGCGAAAAATGTAACAGACA
TTAATTTCGATATGCCAACACGTAAGTATGACCTTAAAAAGCAGAATCATTA
TTAGATGAAGCTGGTTGGAAGAAAGGTAAAGACAGCGATGTTCGTCAAAAAG
ATGGTAAAAACCTTGAAATGGCAATGTACTATGACAAAGGTTCTTCAAGTCAA
AAAGAACAAGCAGAATACTTACAAGCAGAATTTAAGAAATGGGTATTAAGT
TAAACATCAATGGCGAAACATCAGATAAAATTGCTGAACGTCGTACTTCTGGT
GATTATGACTTAATGTTCAACCAAACTTGGGGATTATTGTACGATCCACAAAG
TACTATTGCAGCATTTAAAGAGAAAATGGTTATGAAAGTGCAACATCAGGC
ATTGAGAACAAAGATAAAATATACAACAGCATTGATGACGCATTTAAAATCC
AAAACGGTAAAGAGCGTTCAGACGCTTATAAAACATTTTGAAACAAATTGA
TGATGAAGGTATCTTTATCCCTATTTCACACGGTAGTATGACAGTTGTTGCACC
AAAAGATTTAGAAAAGTATCATTCACACAATCACAGTATGAATTACCATTCA
ATGAAATGCAGTATAAATAA (SEQ ID NO:450)

Figure 105

ATGAGAAAACTAACTAAAATGAGTGCAATGTTACTTGCATCAGGGCTAATTTT
AACTGGTTGTGGCGGTAATAAAGGTTTAGAGGAGAAAAAGAAAACAAGCAA
TTAACGTATACGACGGTTAAAGATATCGGTGATATGAATCCGCATGTTTACGG
TGGATCGATGTCTGCTGAAAGTATGATATACGAGCCGCTTGTACGTAACACGA
AAGATGGAATTAAGCCTTTACTAGCTAAAAATGGGATGTGTCTGAAGATGG
GAAGACATATCATTCCATTTGAGAGATGACGTTAAATTCCATGATGGTACAC
CATTTGATGCTGACGCAGTTAAGAAAATATTGATGCGGTTCAACAAAATAAA
AAATTGCATTCTTGGTTAAAGATTTCAACATTAATTGACAATGTTAAAGTTAA
AGATAAGTACACGGTTGAATTGAATTTGAAAGAAGCATATCAACCTGCATTGG
CTGAATTAGCGATGCCTCGTCCATATGTATTTGTGTCTCCAAAAGACTTTAAAA
ACGGTACAACAAAAGATGGCGTTAAAAAGTTCGATGGTACTGGTCCATTTAAA
TTAGGTGAACATAAAAAGATGAGTCTGCAGACTTTAACAAAAATGATCAAT
ACTGGGGCGAAAAGTCTAAACTTAACAAAGTACAAGCAAAGTAATGCCTGC
TGGTGAAACAGCATTCCTATCAATGAAAAAGGTGAAACGAACTTTGCCTTCA
CAGATGATAGAGGTACGGATAGCTTAGACAAAGACTCTTTAAAACAATTGAA
AGATACAGGTGACTATCAAGTTAAGCGTAGTCAACCTATGAATACGAAAATGT
TAGTTGTCAATTCTGGTAAAAAGATAACGCTGTGAGTGACAAAACAGTCAG
ACAAGCGATTGGTCATATGGTAAACAGAGATAAAATTGCCAAAGAAATTTTA
GATGGTCAAGAAAACCAGCAACTCAATTATTTGCGAAAAATGTAACAGATA
TTAATTTCGATATGCCAACACGTAAGTATGACCTTAAAAAAGCAGAATCATTA
TTAGATGAAGCTGGTTGGAAGAAAGGTAAAGACAGCGATGTTCGTCAAAAAG
ATGGTAAAAACCTTGAAATGGCAATGTACTATGACAAAGGTTCTTCAAGTCAA
AAAGAACAAGCAGAATACTTACAAGCAGAATTTAAGAAAATGGGTATTAAGT
TAAACATCAATGGCGAAACATCAGATAAAATTGCTGAACGTCGTACTTCTGGT
GATTATGACTTAATGTTCAACCAAACTTGGGGATTATTGTACGATCCACAAAG
TACTATTGCAGCATTTAAAGCGAAAATGGTTATGAAAGTGCAACATCAGGCA
TTGAGAACAAGATAAAATATCAACAGCATTGATGACGCATTTAAAATCCA
AAACGGTAAAGAGCGTTCAGGCGCTTATAAAACATTTTGAAACAAATTGAT
GATGAAGGTATCTTTATCCCTATTTCACACGGTAGTATGACAGTTGTTGCGCCG
AAAGATTTAGAAAAGTATCATTCACACAATCACAGTATGAATTACCATTCAA
TGAAATGCAGTATAAATAA (SEQ ID NO:451)

Figure 106

TCATCTGATAGCAAAGATAAGGAAACAACTTCAATTAAACATGCAATGGGTA
CAACTGAAATTAAAGGGAAACCAAAGCGTGTTGTTACGCTATATCAAGGTGCC
ACTGACGTCGCTGTATCTTTAGGTGTTAAACCTGTAGGTGCTGTAGAATCATG
GACACAAAACCGAAATTCGAATACATAAAAAATGATTTAAAAGATACTAAG
ATTGTAGGTCAAGAACCTGCACCTAACTTAGAGGAAATCTCTAAATTAAAACC
GGACTTAATTGTCGCGTCAAAAGTTAGAAATGAAAAGTTTACGATCAATTAT
CTAAAATCGCACCAACAGTTTCTACTGATACAGTTTTCAAATTCAAAGATACA
ACTAAGTTAATGGGGAAAGCTTAGGGAAAGAAAAGAAGCTGAAGATTTAC
TTAAAAAGTACGATGATAAAGTAGCTGCATTCCAAAAAGATGCAAAAGCAAA
GTATAAAGATGCATGGCCATTGAAAGCTTCAGTTGTTAACTTCCGTGCTGATC
ATACAAGAATTTATGCTGGTGGATATGCTGGTGAAATCTTAAATGATTAGGA
TTCAAACGTAATAAAGACTTACAAAAACAAGTTGATAATGGTAAAGATATTAT
CCAACTTACATCTAAAGAAAGTATTCCATTAATGAACGCTGATCATATTTTGT
AGTAAAATCAGATCCAAATGCGAAAGATGCTGCATTAGTTAAAAAGACTGAA
AGCGAATGGACTTCAAGTAAAGAGTGGAAAAATTTAGACGCAGTTAAAAACA
ACCAAGTATCTGATGATTTAGATGAAATCACTTGGAACTTAGCTGGCGGATAT
AAATCATCATTAAAACTTATTGACGATTTATATGAAAGTTAAATATTGAAAA
ACAATCAAAATAA
(SEQ ID NO:452)

Figure 107

ATGAATAAAGTAATTAAAATGCTTGTTGTTACGCTTGCTTTCCTACTTGTTTTA
GCAGGATGTAGTGGGAATTCAAATAAACAATCATCTGATAACAAAGATAAGG
AAACAACTTCAATTAAACATGCAATGGGTACAACTGAAATTAAAGGGAAACC
AAAGCGTGTTGTTACGCTATATCAAGGTGCCACTGACGTCGCTGTATCTTTAG
GTGTTAAACCTGTAGGTGCTGTAGAATCATGGACACAAAACCGAAATTCGA
ATACATAAAAAATGATTTAAAAGATACTAAGATTGTAGGTCAAGAACCTGCG
CCTAACTTAGAGGAAATCTCTAAATTAAAACCGGACTTAATTGTCGCGTCAAA
AGTTAGAAATGAAAAGTTTACGATCAATTATCTAAAATCGCACCAACAGTTT
CTACTGATACAGTTTTCAAATTCAAAGATACAACTAAGTTAATGGGGAAAGCT
TTAGGGAAAGAAAAGAAGCTGAAGATTTACTTAAAAAGTACGATGATAAAG
TAGCTGCATTCCAAAAAGATGCAAAAGCAAAGTATAAAGATGCATGGCCATT
GAAAGCTTCAGTTGTTAACTTCCGTGCTGATCATACAAGAATTTATGCTGGTG
GATATGCTGGTGAAATCTTAAATGATTTAGGATTCAAACGTAATAAAGACTTA
CAAAAACAAGTTGATAATGGTAAAGATATTATCCAACTTACATCTAAAGAAA
GCATTCCATTAATGAACGCTGATCATATTTTGTAGTAAAATCAGATCCAAAT
GCGAAAGATGCTGCATTAGTTAAAAAGACTGAAAGCGAATGGACTTCAAGTA
AAGAGTGGAAAAATTTAGACGCAGTTAAAAACAACCAAGTATCTGATGATTT
AGATGAAATCACTTGGAACTTAGCTGGCGGATATAAATCATCATTAAAACTTA
TTGACGATTTATATGAAAGTTAAATATTGAAAAACAATCAAAATAA
(SEQ ID NO:453)

Figure 108

ATGAATAAAGTAATTAAAATGCTTGTTGTTACGCTTGCTTTCCTACTTGTTTTA
GCAGGATGTAGTGGGAATTCAAATAAACAATCATCTGATAACAAAGATAAGG
AAACAACTTCAATTAAACATGCAATGGGTACAACTGAAATTAAAGGGAAACC
AAAGCGTGTTGTTACGCTATATCAAGGTGCCACTGACGTCGCTGTATCTTTAG
GTGTTAAACCTGTAGGTGCTGTAGAATCATGGACACAAAACCGAAATTCGA
ATACATAAAAATGATTTAAAAGATACTAAGATTGTAGGTCAAGAACCTGCA
CCTAACTTAGAGGAAATCTCTAAATTAAAACCGGACTTAATTGTCGCGTCAAA
AGTTAGAAATGAAAAGTTTACGATCAATTATCTAAAATCGCACCAACAGTTT
CTACTGATACAGTTTTCAAATTCAAAGATACAACTAAGTTAATGGGGAAAGCT
TTAGGGAAAGAAAAGAAGCTGAAGATTTACTTAAAAAGTACGATGATAAAG
TAGCTGCATTCCAAAAAGATGCAAAAGCAAAGTATAAAGATGCATGGCCATT
GAAAGCTTCAGTTGTTAACTTCCGTGCTGATCATACAAGAATTTATGCTGGTG
GATATGCTGGTGAAATCTTAAATGATTTAGGATTCAAACGTAATAAAGACTTA
CAAAAACAAGTTGATAATGGTAAAGATATTCCAACTTACATCTAAAGAAA
GCATTCCATTAATGAACGCTGATCATATTTTGTAGTAAAATCAGATCCAAAT
GCGAAAGATGCTGCATTAGTTAAAAGACTGAAAGCGAATGGACTTCAAGTA
AAGAGTGGAAAAATTTAGACGCAGTTAAAAACAACCAAGTATCTGATGATTT
AGATGAAATCACTTGGAACTTAGCTGGCGGATATAAATCTTCATTAAAACTTA
TTGACGATTTATATGAAAGTTAAATATTGAAAACAATCAAAATAA
(SEQ ID NO:454)

Figure 109

ATGAATAAAGTAATTAAAATGCTTGTTGTTACGCTTGCTTTCCTACTTGTTTTA
GCAGGATGTAGTGGGAATTCAAATAAGCAATCATCTGATAGCAAAGATAAGG
AAACAACTTCAATTAAACATGCAATGGGTACAACTGAAATTAAAGGGAAACC
AAAGCGCGTTGTTACACTATATCAAGGTGCCACTGACGTCGCTGTATCTTTAG
GTGTTAAACCTGTAGGTGCTGTAGAATCATGGACACAAAACCGAAATTCGA
ATACATAAAAATGATTTAAAGATACTAAGATTGTAGGTCAAGAACCTGCA
CCTAACTTAGAAGAAATCTCTAAATTAAAACCGGACTTAATTGTCGCGTCAAA
AGTTAGAAATGAAAAGTTTACGATCAATTATCTAAAATCGCACCAACAGTTT
CTACTGATACAGTTTTCAAATTCAAAGATACAACTAAGTTAATGGGGAAAGCT
TTAGGGAAAGAAAAAGAAGCTGAAGATTTACTTAAAAAGTACGATGATAAAG
TAGCTGCATTCCAAAAAGATGCAAAAGCAAAGTATAAAGATGCATGGCCATT
GAAAGCTTCAGTTGTTAACTTCCGTGCTGATCATACAAGAATTTATGCTGGTG
GATATGCTGGTGAAATCTTAAATGATTTAGGATTCAAACGTAATAAAGACTTA
CAAAAACAAGTTGATAATGGTAAAGATATTATCCAACTTACATCTAAAGAAA
GCATTCCATTAATGAACGCTGATCATATTTTTGTAGTAAAATCAGATCCAAAT
GCGAAAGATGCTGCATTAGTTAAAAAGACTGAAAGCGAATGGACTTCAAGTA
AAGAGTGGAAAAATTTAGACGCAGTTAAAAACAACCAAGTATCTGATGATTT
AGATGAAATCACTTGGAACTTAGCTGGCGGATATAAATCATCATTAAAACTTA
TTGACGATTTATATGAAAGTTAAATATTGAAAAACAATCAAAATAA
(SEQ ID NO:455)

Figure 110

ATGAATAAAGTAATTAAAATGCTTGTTGTTACGCTTGCTTTCCTACTTGTTTTA
GCAGGATGTAGTGGGAATTCAAATAAACAATCATCTGATAACAAAGATAAGG
AAACAACTTCAATTAAACATGCAATGGGTACAACTGAAATTAAAGGGAAACC
AAAGCGTGTTGTTACGCTATATCAAGGTGCCACTGACGTCGCTGTATCTTTAG
GTGTTAAACCTGTAGGTGCTGTAGAATCATGGACACAAAACCGAAATTCGA
ATACATAAAAAATGATTTAAAAGATACTAAGATTGTAGGTCAAGAACCTGCA
CCTAACTTAGAGGAAATCTCTAAATTAAAACCGGACTTAATTGTCGCGTCAAA
AGTTAGAAATGAAAAGTTTACGATCAATTATCTAAAATCGCACCAACAGTTT
CTACTGATACAGTTTCAAATTCAAAGATACAACTAAGTTAATGGGGAAAGCT
TTAGGGAAAGAAAAGAAGCTGAAGATTTACTTAAAAAGTACGATGATAAAG
TAGCTGCATTCCAAAAAGATGCAAAAGCAAAGTATAAAGATGCATGGCCATT
GAAAGCTTCAGTTGTTAACTTCCGTGCTGATCATACAAGAATTTATGCTGGTG
GATATGCTGGTGAAATCTTAAATGATTTAGGATTCAAACGTAATAAAGACTTA
CAAAAACAAGTTGATAATGGTAAAGATATTATCCAACTTACATCCAAAGAAA
GCATTCCATTAATGAACGCTGATCATATTTTTGTAGTAAAATCAGATCCAAAT
GCGAAAGATGCTGCATTAGTTAAAAAGACTGAAAGCGAATGGACTTCAAGTA
AAGAATGGAAAAATTTAGACGCAGTTAAAAACAACCAAGTATCTGATGATTT
AGATGAAATCACTTGGAACTTAGCTGGCGGATATAAATCATCATTAAAATTGA
TTGACGATTTATATGAAAGTTAAATATTGAAAAACAATCAAAATAA
(SEQ ID NO:456)

Figure 111

ATGAATAAAGTAATTAAAATGCTTGTTGTTACGCTTGCTTTCCTACTTGTTTTA
GCAGGATGTAGTGGGAATTCAAATAAACAATCATCTGATAACAAAGATAAGG
AAACAACTTCAATTAAACATGCAATGGGTACAACTGAAATTAAAGGGAAACC
AAAGCGTGTTGTTACGCTATATCAAGGTGCCACTGACGTCGCTGTATCTTTAG
GTGTTAAACCTGTAGGTGCTGTAGAATCATGGACACAAAAACCGAAATTCGA
ATACATAAAAATGATTTAAAAGATACTAAGATTGTAGGTCAAGAACCTGCA
CCTAACTTAGAGGAAATCTCTAAATTAAAACCGGACTTAATTGTCGCGTCAAA
AGTTAGAAATGAAAAGTTTACGATCAATTATCTAAAATCGCACCAACAGTTT
CTACTGATACAGTTTTCAAATTCAAAGATACAACTAAGTTAATGGGGAAAGCT
TTAGGGAAAGAAAAGAAGCTGAAGATTTACTTAAAAAGTACGATGATAAAG
TAGCTGCATTCCAAAAAGATGCAAAAGCAAAGTATAAAGATGCATGGCCATT
GAAAGCTTCAGTTGTTAACTTCCGTGCTGATCATACAAGAATTTATGCTGGTG
GATATGCTGGTGAAATCTTAAATGATTTAGGATTCAAACGTAATAAAGACTTA
CAAAAACAAGTTGATAATGGTAAAGATATTATCCAACTTACATCTAAAGAAA
GCATTCCATTAATGAACGCTGATCATATTTTGTAGTAAAATCAGATCCAAAT
GCGAAAGATGCTGCATTAGTTAAAAAGACTGAAAGCGAATGGACTTCAAGTA
AAGAGTGGAAAAATTTAGACGCAGTTAAAAACAACCAAGTATCTGATGATTT
AGATGAAATCACTTGGAACTTAGCTGGCGGATATAAATCTTCATTAAAACTTA
TTGACGATTTATATGAAAGTTAAATATTGAAAACAATCAAAATAA
(SEQ ID NO:457)

Figure 112

ATGAATAAAGTAATTAAAATGCTTGTTGTTACGCTTGCTTTCCTACTTGTTTTA
GCAGGATGTAGTGGGAATTCAAATAAACAATCATCTGATAACAAAGATAAGG
AAACAACTTCAATTAAACATGCAATGGGTACAACTGAAATTAAAGGGAAACC
AAAGCGTGTTGTTACGCTATATCAAGGTGCCACTGACGTCGCTGTATCTTTAG
GTGTTAAACCTGTAGGTGCTGTAGAATCATGGACACAAAAACCGAAATTCGA
ATACATAAAAAATGATTTAAAAGATACTAAGATTGTAGGTCAAGAACCTGCA
CCTAACTTAGAGGAAATCTCTAAATTAAAACCGGACTTAATTGTCGCGTCAAA
AGTTAGAAATGAAAAGTTTACGATCAATTATCTAAAATCGCACCAACAGTTT
CTACTGATACAGTTTTCAAATTCAAAGATACAACTAAGTTAATGGGGAAAGCT
TTAGGGAAAGAAAAGAAGCTGAAGATTTACTTAAAAAGTACGATGATAAAG
TAGCTGCATTCCAAAAAGATGCAAAAGCAAAGTATAAAGATGCATGGCCATT
GAAAGCTTCAGTTGTTAACTTCCGTGCTGATCATACAAGAATTTATGCTGGTG
GATATGCTGGTGAAATCTTAAATGATTTAGGATTCAAACGTAATAAAGACTTA
CAAAAACAAGTTGATAATGGTAAAGATATTATCCAACTTACATCTAAAGAAA
GCATTCCATTAATGAACGCTGATCATATTTTGTAGTAAAATCAGATCCAAAT
GCGAAAGATGCTGCATTAGTTAAAAAGACTGAAAGCGAATGGACTTCAAGTA
AAGAGTGGAAAAATTTAGACGCAGTTAAAAACAACCAAGTATCTGATGATTT
AGATGAAATCACTTGGAACTTAGCTGGCGGATATAAATCTTCATTAAAACTTA
TTGACGATTTATATGAAAGTTAAATATTGAAAACAATCAAATAA
(SEQ ID NO:458)

Figure 113

ATGAATAAAGTAATTAAAATGCTTGTTGTTACGCTTGCTTTCCTACTTGTTTTA
GCAGGATGTAGTGGGAATTCAAATAAACAATCATCTGATAACAAAGATAAGG
AAACAACTTCAATTAAACATGCAATGGGTACAACTGAAATTAAAGGGAAACC
AAAGCGTGTTGTTACGCTATATCAAGGTGCCACTGACGTCGCTGTATCTTTAG
GTGTTAAACCTGTAGGTGCTGTAGAATCATGGACACAAAAACCGAAATTCGA
ATACATAAAAATGATTTAAAGATACTAAGATTGTAGGTCAAGAACCTGCA
CCTAACTTAGAGGAAATCTCTAAATTAAAACCGGACTTAATTGTCGCGTCAAA
AGTTAGAAATGAAAAGTTTACGATCAATTATCTAAAATCGCACCAACAGTTT
CTACTGATACAGTTTTCAAATTCAAAGATACAACTAAGTTAATGGGGAAAGCT
TTAGGGAAAGAAAAGAAGCTGAAGATTTACTTAAAAAGTACGATGATAAAG
TAGCTGCATTCCAAAAAGATGCAAAAGCAAAGTATAAAGATGCATGGCCATT
GAAAGCTTCAGTTGTTAACTTCCGTGCTGATCATACAAGAATTTATGCTGGTG
GATATGCTGGTGAAATCTTAAATGATTTAGGATTCAAACGTAATAAAGACTTA
CAAAAACAAGTTGATAATGGTAAAGATATTATCCAACTTACATCTAAAGAAA
GCATTCCATTAATGAACGCTGATCATATTTTTGTAGTAAAATCAGATCCAAAT
GCGAAAGATGCTGCATTAGTTAAAAAGACTGAAAGCGAATGGACTTCAAGTA
AAGAGTGGAAAAATTTAGACGCAGTTAAAAACAACCAAGTATCTGATGATTT
AGATGAAATCACTTGGAACTTAGCTGGCGGATATAAATCTTCATTAAAACTTA
TTGACGATTTATATGAAAAGTTAAATATTGAAAAACAATCAAAATAA
(SEQ ID NO:459)

Figure 114

ATGAATAAAGTAATTAAAATGCTTGTTGTTACGCTTGCTTTCCTACTTGTTTTA
GCAGGATGTAGTGGGAATTCAAATAAACAATCATCTGATAACAAAGATAAGG
AAACAACTTCAATTAAACATGCAATGGGTACAACTGAAATTAAAGGGAAACC
AAAGCGTGTTGTTACGCTATATCAAGGTGCCACTGACGTCGCTGTATCTTTAG
GTGTTAAACCTGTAGGTGCTGTAGAATCATGGACACAAAAACCGAAATTCGA
ATACATAAAAAATGATTTAAAAGATACTAAGATTGTAGGTCAAGAACCTGCA
CCTAACTTAGAGGAAATCTCTAAATTAAAACCGGACTTAATTGTCGCGTCAAA
AGTTAGAAATGAAAAGTTTACGATCAATTATCTAAAATCGCACCAACAGTTT
CTACTGATACAGTTTTCAAATTCAAAGATACAACTAAGTTAATGGGGAAAGCT
TTAGGGAAAGAAAAGAAGCTGAAGATTTACTTAAAAAGTACGATGATAAAG
TAGCTGCATTCCAAAAAGATGCAAAAGCAAAGTATAAAGATGCATGGCCATT
GAAAGCTTCAGTTGTTAACTTCCGTGCTGATCATACAAGAATTTATGCTGGTG
GATATGCTGGTGAAATCTTAAATGATTTAGGATTCAAACGTAATAAAGACTTA
CAAAAACAAGTTGATAATGGTAAAGATATTATCCAACTTACATCTAAAGAAA
GCATTCCATTAATGAACGCTGATCATATTTTTGTAGTAAAATCAGATCCAAAT
GCGAAAGATGCTGCATTAGTTAAAAAGACTGAAAGCGAATGGACTTCAAGTA
AAGAGTGGAAAAATTTAGACGCAGTTAAAAACAACCAAGTATCTGATGATTT
AGATGAAATCACTTGGAACTTAGCTGGCGGATATAAATCTTCATTAAAACTTA
TTGACGATTTATATGAAAAGTTAAATATTGAAAAACAATCAAAATAA (SEQ ID NO:460)

Figure 115

ATGAATAAAGTAATTAAAATGCTTGTTGTTACGCTTGCTTTCCTACTTGTTTTA
GCAGGATGTAGTGGGAATTCAAATAAACAATCATCTGATAACAAAGATAAGG
AAACAACTTCAATTAAACATGCAATGGGTACAACTGAAATTAAAGGGAAACC
AAAGCGTGTTGTTACGCTATATCAAGGTGCCACTGACGTCGCTGTATCTTTAG
GTGTTAAACCTGTAGGTGCTGTAGAATCATGGACACAAAAACCGAAATTCGA
ATACATAAAAATGATTTAAAGATACTAAGATTGTAGGTCAAGAACCTGCA
CCTAACTTAGAGGAAATCTCTAAATTAAAACCGGACTTAATTGTCGCGTCAAA
AGTTAGAAATGAAAAGTTTACGATCAATTATCTAAAATCGCACCAACAGTTT
CTACTGATACAGTTTTCAAATTCAAAGATACAACTAAGTTAATGGGGAAAGCT
TTAGGGAAAGAAAAGAAGCTGAAGATTTACTTAAAAAGTACGATGATAAAG
TAGCTGCATTCCAAAAAGATGCAAAGCAAAGTATAAAGATGCATGGCCATT
GAAAGCTTCAGTTGTTAACTTCCGTGCTGATCATACAAGAATTTATGCTGGTG
GATATGCTGGTGAAATCTTAAATGATTTAGGATTCAAACGTAATAAAGACTTA
CAAAAACAAGTTGATAATGGTAAAGATATTATCCAACTTACATCTAAAGAAA
GCATTCCATTAATGAACGCTGATCATATTTTTGTAGTAAAATCAGATCCAAAT
GCGAAAGATGCTGCATTAGTTAAAAAGACTGAAAGCGAATGGACTTCAAGTA
AAGAGTGGAAAAATTTAGACGCAGTTAAAAACAACCAAGTATCTGATGATTT
AGATGAAATCACTTGGAACTTAGCTGGCGGATATAAATCTTCATTAAAACTTA
TTGACGATTTATATGAAAGTTAAATATTGAAAACAATCAAAATAA
(SEQ ID NO:461)

Figure 116

ATGAATAAAGTAATTAAAATGCTTGTTGTTACGCTTGCTTTCCTACTTGTTTTA
GCAGGATGTAGTGGGAATTCAAATAAACAATCATCTGATAACAAAGATAAGG
AAACAACTTCAATTAAACATGCAATGGGTACAACTGAAATTAAAGGGAAACC
AAAGCGTGTTGTTACGCTATATCAAGGTGCCACTGACGTCGCTGTATCTTTAG
GTGTTAAACCTGTAGGTGCTGTAGAATCATGGACACAAAAACCGAAATTCGA
ATACATAAAAAATGATTTAAAAGATACTAAGATTGTAGGTCAAGAACCTGCA
CCTAACTTAGAGGAAATCTCTAAATTAAAACCGGACTTAATTGTCGCGTCAAA
AGTTAGAAATGAAAAGTTTACGATCAATTATCTAAATCGCACCAACAGTTT
CTACTGATACAGTTTTCAAATTCAAAGATACAACTAAGTTAATGGGGAAAGCT
TTAGGGAAAGAAAAGAAGCTGAAGATTTACTTAAAAAGTACGATGATAAAG
TAGCTGCATTCCAAAAAGATGCAAAAGCAAAGTATAAAGATGCATGGCCATT
GAAAGCTTCAGTTGTTAACTTCCGTGCTGATCATACAAGAATTTATGCTGGTG
GATATGCTGGTGAAATCTTAAATGATTTAGGATTCAAACGTAATAAAGACTTA
CAAAAACAAGTTGATAATGGTAAAGATATTATCCAACTTACATCCAAAGAAA
GCATTCCATTAATGAACGCTGATCATATTTTTGTAGTAAAATCAGATCCAAAT
GCGAAAGATGCTGCATTAGTTAAAAGACTGAAAGCGAATGGACTTCAAGTA
AAGAATGGAAAAATTTAGACGCAGTTAAAAACAACCAAGTATCTGATGATTT
AGATGAAATCACTTGGAACTTAGCTGGCGGATATAAATCATCATTAAAATTGA
TTGACGATTTATATGAAAGTTAAATATTGAAAAACAATCAAAATAA
(SEQ ID NO:462)

Figure 117

AAAGAATCATCAACTAAAGATACTATTTCGGTAAAAGATGAAAATGGTACAG
TAAAAGTACCTAAAGATGCAAAACGTATCGTTGTATTAGAGTACTCATTTGCA
GATGCATTAGCAGCATTAGACGTTAAACCAGTTGGTATTGCTGATGATGGTAA
GAAAAAACGTATCATTAAACCAGTTAGAGAAAAATTGGGGATTATACTTCTG
TAGGTACACGTAAACAGCCAAACTTAGAGGAAATTAGTAAATTAAAACCGGA
TTTAATTATCGCTGATAGCAGTAGACATAAAGGTATTAATAAAGAATTAAACA
AAATTGCACCAACATTATCATTAAAGAGTTTTGATGGAGACTACAAACAAAC
ATTAATTCGTTCAAAACAATTGCTAAAGCTTTAAATAAAGAAAAAGAAGGCG
AAAAGCGTCTTGCTGAACATGATAAATTAATCAAAAAGTATAAAGATGAAAT
TAAGTTTGATAGAAATCAAAAAGTGCTTCCAGCAGTTGTTGCTAAAGCTGGTT
TATTAGCACATCCAAACTATTCATATGTTGGACAATTTTTAAACGAACTTGGAT
TTAAAAATGCATTAAGTGATGATGTAACAAAAGGTTTAAGTAAATACTTGAAA
GGACCTTACTTACAATTAGATACTGAACATTTAGCTGACTTAAATCCTGAACG
CATGATTATTATGACAGATAATGCTAAAAAGATTCTGCTGAATTCAAGAAGT
TACAAGAAGATCCAACTTGGAAAAGTTGAACGCAGTTAAAAATAATCGCGT
GGATATTGTTGACCGTGATGTTTGGGCAAGATCTCGTGGCTTAATTTCTTCTGA
AGAAATGGCTAAGAACTTGTTGAATTATCAAAAAAGAACAAAAG (SEQ ID NO:463)

Figure 118

ATGAAGTTATACATATTAAGGAGTGGAACGATGAGAGGTCTAAAAACTTTTAG
TATATTGGGATTAATAGTTGCCTTATTTTTAGTTGCAGCTTGTGGTAATACGGA
TAATTCAAGTAAAAAGAATCATCAACTAAAGATACTATTTCGGTAAAAGATG
AAAATGGCACAGTAAAAGTACCTAAAGATGCAAAACGTATCGTTGTATTAGA
GTACTCATTTGCAGATGCATTAGCAGCATTAGACGTTAAACCAGTTGGTATTG
CTGATGATGGTAAGAAAAACGTATCATTAAACCAGTTAGAGAAAAATTGG
GGATTATACTTCTGTAGGTACACGTAAACAGCCAAACTTAGAGGAAATTAGTA
AATTAAAACCGGATTTAATTATCGCTGATAGCAGTAGACATAAAGGTATTAAT
AAAGAATTAAACAAAATTGCACCAACATTATCATTAAAGAGTTTTGATGGAGA
CTACAAACAAACATTAATTCGTTCAAAACAATTGCTAAAGCTTTAAATAAAG
AAAAAGAAGGCGAAAAGCGTCTTGCTGAACATGATAAATTAATCAAAAAGTA
TAAAGATGAAATTAAGTTTGATAGAAATCAAAAAGTGCTTCCAGCAGTTGTTG
CTAAAGCTGGTTTATTAGCACATCCAAACTATTCATATGTTGGACAATTTTTAA
ACGAACTTGGATTTAAAAATGCATTAAGTGATGATGTAACAAAAGGTTTAAGT
AAATACTTGAAAGGACCTTACTTACAATTAGATACTGAACATTTAGCTGACTT
AAATCCTGAACGCATGATTATTATGACAGATAATGCTAAAAAAGATTCTGCTG
AATTCAAGAAGTTACAAGAAGATCCAACTTGGAAAAGTTGAATGCAGTTAA
AAATAATCGCGTGGATATTGTTGACCGTGATGTTTGGGCAAGATCTCGTGGCT
TAATTTCTTCTGAAGAAATGGCTAAAGAACTTGTTGAATTATCAAAAAAGAA
CAAAAGTAA
(SEQ ID NO:464)

Figure 119

ATGAGAGGTCTAAAAACTTTTAGTATATTGGGATTAATAGTTGCCTTACTTTTA
GTTGCAGCTTGTGGTAATACGGATAATTCAAGTAAAAAGAATCATCAACTAA
AGATACTATTTCGGTAAAGATGAAAATGGTACAGTAAAAGTACCTAAAGAT
GCAAAACGTATCGTTGTATTAGAGTACTCATTTGCAGATGCATTAGCAGCATT
AGACGTTAAACCAGTTGGTATTGCTGATGATGGTAAGAAAAAACGTATCATTA
AACCAGTTAGAGAAAAATTGGGGATTATACTTCTGTAGGTACACGTAAACA
GCCAAACTTAGAGGAAATTAGTAAATTAAAACCGGATTTAATTATCGCTGATA
GCAGTAGACATAAAGGTATTAATAAAGAATTAAACAAAATTGCACCAACATT
ATCATTAAAGAGTTTTGATGGAGACTACAAACAAAATATTAATTCGTTCAAAA
CAATTGCTAAAGCTTTAAATAAAGAAAAAGAAGGCGAAAAACGTCTTGCTGA
GCATGATAAATTAATCAATAAGTATAAAGATGAAATTAAATTTGATAGAAATC
AAAAAGTGCTTCCAGCAGTAGTTGCTAAAGCTGGTTTATTAGCACATCCAAAC
TATTCATATGTTGGACAATTTTTAAACGAACTAGGATTTAAAAATGCATTAAG
TGACGATGTAACAAAGGTTTAAGTAAATATTTGAAAGGACCTTACTTACAAT
TAGACACTGAACATTTAGCTGATTTAAATCCAGAGCGTATGATCATTATGACA
GATCATGCTAAAAAGATTCTGCTGAATTCAAGAAGTTACAAGAAGATGCAA
CATGGAAAAGTTGAATGCAGTTAAAAATAATCGCGTGGATATTGTTGACCGT
GATGTTTGGGCAAGATCTCGTGGCTTAATTTCTTCTGAAGAAATGGCTAAAGA
ACTTGTTGAATTATCAAAAAAGAACAAAGTAA
(SEQ ID NO:465)

Figure 120

ATGAGAGGTCTAAAAACTTTTAGTATATTGGGATTAATAGTTGCCTTATTTTA
GTTGCAGCTTGTGGTAATACGGATAATTCAAGTAAAAAGAATCATCAACTAA
AGATACTATTTCGGTAAAAGATGAAAATGGTACAGTAAAAGTACCTAAAGAT
GCAAAACGTATCGTTGTATTAGAGTACTCATTTGCAGATGCATTAGCAGCATT
AGACGTTAAACCAGTTGGTATTGCTGATGATGGTAAGAAAAAACGTATCATTA
AACCAGTTAGAGAAAAAATTCGGGATTATACTTCTGTAGGTACACGTAAACAG
CCAAACTTAGAGGAAATTAGTAAATTAAAACCGGATTTAATTATCGCTGATAG
CAGTAGACATAAAGGTATTAATAAAGAATTAAACAAAATTGCACCAACATTA
TCATTAAAGAGTTTTGATGGTGACTACAAGCAAAATATCGATGCTTTCAAGAC
AATTGCGAAAGCTTTAGATAAAGAAAAGAAGGCGAAAAACGTCTTGCTGAA
CATGATAAATTAATCAATAAGTATAAAGATGAAATTAAATTTGATAGAAATCA
AAAAGTGCTTCCAGCAGTTGTTGCGAAAGCTGGTTTATTAGCACATCCAAACT
ATTCGTATGTTGGACAATTTTAAACGAACTTGGATTTAAAAATGCATTAAGT
GATGATGTAACAAAGGTTTAAGTAAATACTTGAAAGGACCTTACTTACAATT
AGATACTGAACATTTAGCTGACTTAAATCCTGAACGCATGATTATTATGACAG
ATAATGCTAAAAAGATTCTGCTGAATTCAAGAAGTTACAAGAAGATGCAAC
ATGGAAAAATTGAATGCAGTTAAAAATAATCGTGTTGATATTGTTGACCGTG
ATGTTTGGGCAAGATCTCGTGGCTTAATTTCTTCTGAAGAAATGGCTAAAGAA
CTTGTTGAATTATCAAAAAAGAACAAAGTAA (SEQ ID NO:466)

Figure 121

ATGAGAGGTCTAAAAACTTTTAGTATATTGGGATTAATAGTTGCCTTACTTTTA
GTTGCAGCTTGTGGTAATACGGATAATTCAAGTAAAAAGAATCATCAACTAA
AGATACTATTTCGGTAAAAGATGAAAATGGTACAGTAAAAGTACCTAAAGAT
GCAAAACGTATCGTTGTATTAGAGTACTCATTTGCAGATGCATTAGCAGCATT
AGACGTTAATCCAGTTGGTATTGCTGATGATGGTAAGAAAAACGTATCATTA
AACCAGTTAGAGAAAAATTGGGGATTATACTTCTGTAGGTACACGTAAACA
GCCAAACTTAGAAGAAATTAGTAAATTAAAACCGGATTTAATTATCGCTGATA
GCAGTAGACATAAAGGTATTAATAAAGAATTAAACAAAATTGCACCAACATT
ATCATTAAAGAGTTTTGATGGAGACTACAAACAAACATTAATTCGTTCAAAA
CAATTGCTAAAGCTTTAAATAAAGAAAAGAAGGCGAAAAACGTCTTGCTGA
GCATGATAAATTAATCAATAAGTATAAAGATGAAATTAAATTTGATAGAAATC
AAAAAGTGCTTCCAGCAGTAGTTGCTAAAGCTGGTTTATTAGCACATCCAAAC
TATTCATATGTTGGACAATTTTTAAACGAACTAGGATTTAAAAATGCATTAAG
TGACGATGTAACAAAGGTTTAAGTAAATATTTGAAAGGACCTTACTTACAAT
TAGACACTGAACATTTAGCTGATTTAAATCCAGAGCGTATGATCATTATGACT
GATCACGCTAAAAAGATTCTGCTGAATTCAAGAATTACAAGAAGATGCAA
CATGGAAAAATTGAATGCAGTTAAAAATAATCGCGTGGATATTGTTGACCGT
GATGTTTGGGCAAGATCTCGTGGCTTAATTTCTTCTGAAGAAATGGCTAAAGA
ACTTGTTGAATTATCAAAAAAGAACAAAAGTAA
(SEQ ID NO:467)

Figure 122

ATGAGAGGTCTAAAAACTTTTAGTATATTGGGATTAATAGTTGCCTTACTTTTA
GTTGCAGCTTGTGGTAATACGGATAATTCAAGTAAAAAGAATCATCAACTAA
AGATACTATTTCGGTAAAAGATGAAAATGGTACAGTAAAAGTACCTAAAGAT
GCAAAACGTATCGTTGTATTAGAGTACTCATTTGCAGATGCATTAGCAGCATT
AGACGTTAAACCAGTTGGTATTGCTGATGATGGTAAGAAAAAACGTATCATTA
AACCAGTTAGAGAAAAATTGGGGATTATACTTCTGTAGGTACACGTAAACA
GCCAAACTTAGAAGAAATTAGTAAATTAAAACCGGATTTAATTATCGCTGATA
GCAGTAGACATAAAGGTATTAATAAAGAATTAAACAAAATTGCACCAACATT
ATCATTAAAGAGTTTTGATGGAGACTACAAACAAATATTAATTCGTTCAAAA
CAATTGCTAAAGCTTTAAATAAAGAAAAGAAGGCGAAAAACGTCTTGCTGA
GCATGATAAATTAATCAATAAGTATAAAGATGAAATTAAATTTGATAGAAATC
AAAAAGTGCTTCCAGCAGTAGTTGCTAAAGCTGGTTTATTAGCACATCCAAAC
TATTCATATGTTGGACAATTTTTAAACGAACTAGGATTTAAAAATGCATTAAG
TGACGATGTAACAAAAGGTTTAAGTAAATATTTGAAAGGACCTTACTTACAAT
TAGACACTGAACATTTAGCTGATTTAAATCCAGAGCGTATGATCATTATGACA
GATCATGCTAAAAAAGATTCTGCTGAATTCAAGAAGTTACAAGAAGATGCAA
CATGGAAAAGTTGAATGCAGTTAAAAATAATCGCGTGGATATTGTTGACCGT
GATGTTTGGGCAAGATCTCGTGGCTTAATTTCTTCTGAAGAAATGGCTAAAGA
ACTTGTTGAATTATCAAAAAAGAACAAAAGTAA (SEQ ID NO:468)

Figure 123

ATGAGAGGTCTAAAAACTTTTAGTATATTGGGATTAATAGTTGCCTTACTTTTA
GTTGCAGCTTGTGGTAATACGGATAATTCAAGTAAAAAGAATCATCAACTAA
AGATACTATTTCGGTAAAAGATGAAAATGGTACAGTAAAAGTACCTAAAGAT
GCAAACGTATCGTTGTATTAGAGTACTCATTTGCAGATGCATTAGCAGCATT
AGACGTTAAACCAGTTGGTATTGCTGATGATGGTAAGAAAAAACGTATCATTA
AACCAGTTAGAGAAAAATTGGGGATTATACTTCTGTAGGTACACGTAAACA
GCCAAACTTAGAGGAAATTAGTAAATTAAAACCGGATTTAATTATCGCTGATA
GCAGTAGACATAAAGGTATTAATAAAGAATTAAACAAAATTGCACCAACATT
ATCATTAAAGAGTTTTGATGGAGACTACAAACAAATATTAATTCGTTCAAAA
CAATTGCTAAAGCTTTAAATAAAGAAAAGAAGGCGAAAACGTCTTGCTGA
GCATGATAAATTAATCAATAAGTATAAAGATGAAATTAAATTTGATAGAAATC
AAAAAGTGCTTCCAGCAGTAGTTGCTAAAGCTGGTTTATTAGCACATCCAAAC
TATTCATATGTTGGACAATTTTTAAACGAACTAGGATTTAAAAATGCATTAAG
TGACGATGTAACAAAAGGTTTAAGTAAATATTTGAAAGGACCTTACTTACAAT
TAGACACTGAACATTTAGCTGATTTAAATCCAGAGCGTATGATCATTATGACA
GATCATGCTAAAAAAGATTCTGCTGAATTCAAGAAGTTACAAGAAGATGCAA
CATGGAAAAGTTGAATGCAGTTAAAAATAATCGCGTGGATATTGTTGACCGT
GATGTTTGGGCAAGATCTCGTGGCTTAATTTCTTCTGAAGAAATGGCTAAAGA
ACTTGTTGAATTATCAAAAAAGAACAAAGTAA
(SEQ ID NO:469)

Figure 124

ATGAGAGGTCTAAAAACTTTTAGTATATTGGGATTAATAGTTGCCTTACTTTTA
GTTGCAGCTTGTGGTAATACGGATAATTCAAGTAAAAAGAATCATCAACTAA
AGATACTATTTCGGTAAAGATGAAAATGGTACAGTAAAAGTACCTAAAGAT
GCAAACGTATCGTTGTATTAGAGTACTCATTTGCAGATGCATTAGCAGCATT
AGACGTTAAACCAGTTGGTATTGCTGATGATGGTAAGAAAAACGTATCATTA
AACCAGTTAGAGAAAAATTGGGGATTATACTTCTGTAGGTACACGTAAACA
GCCAAACTTAGAAGAAATTAGTAAATTAAAACCGGATTTAATTATCGCTGATA
GCAGTAGACATAAAGGTATTAATAAAGAATTAAACAAAATTGCACCAACATT
ATCATTAAAGAGTTTTGATGGAGACTACAAACAAATATTAATTCGTTCAAAA
CAATTGCTAAAGCTTTAAATAAAGAAAAAGAAGGCGAAAAACGTCTTGCTGA
GCATGATAAATTAATCAATAAGTATAAAGATGAAATTAAATTTGATAGAAATC
AAAAAGTGCTTCCAGCAGTAGTTGCTAAAGCTGGTTTATTAGCACATCCAAAC
TATTCATATGTTGGACAATTTTTAAACGAACTAGGATTTAAAAATGCATTAAG
TGACGATGTAACAAAAGGTTTAAGTAAATATTTGAAAGGACCTTACTTACAAT
TAGACACTGAACATTTAGCTGATTTAAATCCAGAGCGTATGATCATTATGACA
GATCATGCTAAAAAGATTCTGCTGAATTCAAGAAGTTACAAGAAGATGCAA
CATGGAAAAGTTGAATGCAGTTAAAAATAATCGCGTGGATATTGTTGACCGT
GATGTTTGGGCAAGATCTCGTGGCTTAATTTCTTCTGAAGAAATGGCTAAAGA
ACTTGTTGAATTATCAAAAAAGAACAAAGTAA
(SEQ ID NO:470)

Figure 125

ATGAGAGGTCTAAAAACTTTTAGTATATTGGGATTAATAGTTGCCTTACTTTTA
GTTGCAGCTTGTGGTAATACGGATAATTCAAGTAAAAAGAATCATCAACTAA
AGATACTATTTCGGTAAAAGATGAAAATGGTACAGTAAAAGTACCTAAAGAT
GCAAACGTATCGTTGTATTAGAGTACTCATTTGCAGATGCATTAGCAGCATT
AGACGTTAAACCAGTTGGTATTGCTGATGATGGTAAGAAAAACGTATCATTA
AACCAGTTAGAGAAAAATTGGGGATTATACTTCTGTAGGTACACGTAAACA
GCCAAACTTAGAAGAAATTAGTAAATTAAAACCGGATTTAATTATCGCTGATA
GCAGTAGACATAAAGGTATTAATAAAGAATTAAACAAAATTGCACCAACATT
ATCATTAAAGAGTTTTGATGGAGACTACAAACAAAATATTAATTCGTTCAAAA
CAATTGCTAAAGCTTTAAATAAAGAAAAGAAGGCGAAAAACGTCTTGCTGA
GCATGATAAATTAATCAATAAGTATAAGATGAAATTAAATTTGATAGAAATC
AAAAGTGCTTCCAGCAGTAGTTGCTAAAGCTGGTTTATTAGCACATCCAAAC
TATTCATATGTTGGACAATTTTTAAACGAACTAGGATTTAAAAATGCATTAAG
TGACGATGTAACAAAAGGTTTAAGTAAATATTTGAAAGGACCTTACTTACAAT
TAGACACTGAACATTTAGCTGATTTAAATCCAGAGCGTATGATCATTATGACA
GATCATGCTAAAAAGATTCTGCTGAATTCAAGAAGTTACAAGAAGATGCAA
CATGGAAAAGTTGAATGCAGTTAAAAATAATCGCGTGGATATTGTTGACCGT
GATGTTTGGGCAAGATCTCGTGGCTTAATTTCTTCTGAAGAAATGGCTAAAGA
ACTTGTTGAATTATCAAAAAAGAACAAAAGTAA
(SEQ ID NO:471)

Figure 126

ATGAGAGGTCTAAAAACTTTTAGTATATTGGGATTAATAGTTGCCTTACTTTTA
GTTGCAGCTTGTGGTAATACGGATAATTCAAGTAAAAAAGAATCATCAACTAA
AGATACTATTTCGGTAAAAGATGAAAATGGTACAGTAAAAGTACCTAAAGAT
GCAAAACGTATCGTTGTATTAGAGTACTCATTTGCAGATGCATTAGCAGCATT
AGACGTTAAACCAGTTGGTATTGCTGATGATGGTAAGAAAAAACGTATCATTA
AACCAGTTAGAGAAAAATTGGGGATTATACTTCTGTAGGTACACGTAAACA
GCCAAACTTAGAAGAAATTAGTAAATTAAAACCGGATTTAATTATCGCTGATA
GCAGTAGACATAAAGGTATTAATAAAGAATTAAACAAAATTGCACCAACATT
ATCATTAAAGAGTTTTGATGGAGACTACAAACAAATATTAATTCGTTCAAAA
CAATTGCTAAAGCTTTAAATAAAGAAAAGAAGGCGAAAAACGTCTTGCTGA
GCATGATAAATTAATCAATAAGTATAAAGATGAAATTAAATTTGATAGAAATC
AAAAAGTGCTTCCAGCAGTAGTTGCTAAAGCTGGTTTATTAGCACATCCAAAC
TATTCATATGTTGGACAATTTTTAAACGAACTAGGATTTAAAAATGCATTAAG
TGACGATGTAACAAAAGGTTTAAGTAAATATTTGAAAGGACCTTACTTACAAT
TAGACACTGAACATTTAGCTGATTTAAATCCAGAGCGTATGATCATTATGACA
GATCATGCTAAAAAAGATTCTGCTGAATTCAAGAAGTTACAAGAAGATGCAA
CATGGAAAAGTTGAATGCAGTTAAAAATAATCGCGTGGATATTGTTGACCGT
GATGTTTGGGCAAGATCTCGTGGCTTAATTTCTTCTGAAGAAATGGCTAAAGA
ACTTGTTGAATTATCAAAAAAAGAACAAAAGTAA
(SEQ ID NO:472)

Figure 127

ATGAGAGGTCTAAAAACTTTTAGTATATTGGGATTAATAGTTGCCTTACTTTTA
GTTGCAGCTTGTGGTAATACGGATAATTCAAGTAAAAAGAATCATCAACTAA
AGATACTATTTCGGTAAAAGATGAAAATGGTACAGTAAAAGTACCTAAAGAT
GCAAAACGTATCGTTGTATTAGAGTACTCATTTGCAGATGCATTAGCAGCATT
AGACGTTAATCCAGTTGGTATTGCTGATGATGGTAAGAAAAAACGTATCATTA
AACCAGTTAGAGAAAAATTGGGGATTATACTTCTGTAGGTACACGTAAACA
GCCAAACTTAGAAGAAATTAGTAAATTAAAACCGGATTTAATTATCGCTGATA
GCAGTAGACATAAAGGTATTAATAAAGAATTAAACAAAATTGCACCAACATT
ATCATTAAAGAGTTTTGATGGAGACTACAAACAAACATTAATTCGTTCAAAA
CAATTGCTAAAGCTTTAAATAAAGAAAAGAAGGCGAAAAACGTCTTGCTGA
GCATGATAAATTAATCAATAAGTATAAAGATGAAATTAAATTTGATAGAAATC
AAAAAGTGCTTCCAGCAGTAGTTGCTAAAGCTGGTTTATTAGCACATCCAAAC
TATTCATATGTTGGACAATTTTTAAACGAACTAGGATTTAAAAATGCATTAAG
TGACGATGTAACAAAGGTTTAAGTAAATATTTGAAGGACCTTACTTACAAT
TAGACACTGAACATTTAGCTGATTTAAATCCAGAGCGTATGATCATTATGACT
GATCACGCTAAAAAAGATTCTGCTGAATTCAAGAAATTACAAGAAGATGCAA
CATGGAAAAATTGAATGCAGTTAAAAATAATCGCGTGGATATTGTTGACCGT
GATGTTTGGGCAAGATCTCGTGGCTTAATTTCTTCTGAAGAAATGGCTAAAGA
ACTTGTTGAATTATCAAAAAAGAACAAAGTAA
(SEQ ID NO:473)

Figure 128

ACTGAAGAGAAAACTGAAATGACGACAATAAAGATGAATTAGGAACTGAAA
AAATTAAGAAAATCCTAAACGTGTTGTTGTATTAGAATATAGTTTTGCTGAT
TATTTAGCAGCATTAGATATGAAACCTGTTGGTATTGCAGATGATGGCAGCAG
TAAAATATAACAAAGTCAGTAAGAGATAAGATTGGGGCATATGAATCGGTT
GGATCTAGATCGCAACCGAATATGGAAGTGATAAGTAAATTAAAACCGGATT
TGATCATTGCAGATGTCAGCAGACATAAGAAAATCAAATCAGAATTGAGCAA
AATTGCGCCGACAATTATGTTAGTCAGTGGTACGGGAGATTACAATGCAAATA
TTGAAGCATTTAAAACAGTCGCTAAAGCAGTTGGCAGAGAGAAAGAAGGCGA
AAAGCGTCTGGAAAAGCATGATAAATATTAGCGGAGATTAGAAAGAAAATT
GAACAGAGTACGTTAAAATCTGCATTTGCACTTGGTATCTCAAGAGCAGGTAT
GTTTATTAATAATGAAGATACATTTATGGACAATTTTAATTAAAATGGGTA
TTCAACCTGAAGTCACAAAAGACAAACTGCGCATGTGGGTGAACGCAAGGG
TGGCCCTTATATTTATTTAAATAATGAAGAGCTTGCCAATATCAATCCAAAAG
TTATGATTTTAGCCACTGACGGAAAAACGGACAAAATAGAACGAAATTCATT
GATCCTGCAGTTTGGAAATCATTAAAAGCTGTGAAAGATAACAAAGTTTATGA
CGTTGACCGAAATAAGTGGTTGAAATCAAGGGGTATTATCGCAAGTGAAAGT
ATGGCAGAAGATTTAGAAAAATTGCAGAAAAGCAAAATAA
(SEQ ID NO:474)

Figure 129

ATGGAAGTGATAAGTAAATTAAAACCGGATTTGATCATTGCAGATGTTAACAG
ACATAAGAAAATCAAATCAGAATTGAGCAAAATTGCTCCGACAATCATGTTA
GTTAGCGGTACGGGAGATTATAATGCAAATATTGAAGCATTTAAAACAGTTGC
TAAAGCAGTAGGCAAAGAGAAAGAAGGCGAGAAACGTCTGGAAAAGCATGA
TAAAATATTAGCGGAGATTAGAAAGAAAATTGAACAGAGTACGTTAAAATCT
GCATTTGCATTCGGTATCTCAAGAGCAGGTATGTTTATTAATAATGAAGATAC
ATTTATGGGACAATTCTTAATTAAAATGGGTATTCAACCTGAAGTCACAAAAG
ACAAAACTATGCATGTTGGTGAACGCAAGGGTGGTCCTTATATTTATTTAAAT
AATGAAGAACTTGCCAATATCAATCCAAAAGTTATGATTTTAGCCACTGACGG
AAAAACGGACAAAATAGAACGAAATTCATTGATCCTGCAGTTTGGAAATCA
TTAAAAGCTGTGAAAGATAACAAAGTTTATGACGTTGACCGAAATAAGTGGTT
GAAATCAAGGGGTATTATCGCAAGTGAAAGTATGGCAGAAGATTTAGAAAAA
ATTGCAGAAAAGCAAAATAA
(SEQ ID NO:475)

Figure 130

GTGAATAGGAATATCGTTAAATTAGTTGTGTTTATGCTAATCTTAGTTGTAGCA
GTAGCGGGTTGTGGTCAAAAAGATACTGAAGAGAAAACTGAAATGACGACAA
TAAAAGATGAATTAGGAACTGAAAAAATTAAGAAAAATCCTAAACGTGTTGT
TGTATTAGAATATAGTTTTGCTGATTATTTAGCAGCATTAGATATGAAACCTGT
TGGTATTGCAGATGATGGCAGCACTAAAAATATAACAAAGTCAGTAAGAGAT
AAGATTGGGGCATATGAATCGGTTGGATCTAGACCGCAACCGAATATGGAAG
TGATAAGTAAATTAAAACCGGATTTGATCATTGCAGATGTTAGCAGACATAAG
AAAATCAAATCAGAATTGAGCAAAATTGCTCCGACAATCATGTTAGTTAGCGG
TACGGGAGATTATAATGCAAATATTGAAGCATTTAAAACAGTCGCTAAAGCA
GTAGGCAAAGAGAAGAAGGCGAGAAGCGTCTGGAAAAGCATGATAAAATA
TTAGCGGAGATTAGAAAGAAAATTGAACAGAGTACGTTAAAATCTGCATTTGC
ATTCGGTATCTCAAGAGCAGGTATGTTTATTAATAATGAAGATACATTTATGG
GACAATTCTTAATTAAAATGGGTATTCAACCTGAAGTCACAAAAGACAAAACT
ACGCATGTTGGTGAACGCAAGGGTGGTCCTTATATATATTTAAATAATGAAGA
ACTTGCCAATATCAATCCAAAAGTTATGATTTTAGCCACTGACGGAAAAACGG
ACAAAAATAGAACGAAATTCATTGATCCTGCAGTTTGGAAATCATTAAAAGCT
GTGAAAGATAACAAAGTTTATGACGTTGACCGAAATAAGTGGTTGAAATCAA
GGGGGATTATCGCAAGTGAAAGTATGGCAGAAGATTTAGAAAAAATTGCAGA
AAAAGCAAAATAA
(SEQ ID NO:476)

Figure 131

GTGAATAGGAATATCGTTAAATTAGTTGTGTTTATGCTAATCTTAGTTGTAGCA
GTAGCGGGTTGTGGTCAAAAGATACTGAAGAGAAACTGAAATGACGACGA
TAAAGATGAATTAGGAACTGAAAAAATTAAGAAAAATCCGAAACGTATTGT
TGTATTAGAATATAGTTTTGCTGATTATTTAGCAGCATTAGATATGAACCTGT
TGGTATTGCAGATGATGGTAGTACTAAAAATATAACAAAGTCAGTAAGAGAT
AAGATTGGGGCATATGAATCGGTTGGATCTAGACCGCAACCGAATATGGAAG
TGATAAGTAAATTAAAACCGGATTTGATTATTGCAGATGTCAGCAGACATAAG
AAAATCAAATCAGAATTGAGCAAAATTGCGCCGACAATCATGTTAGTTAGCG
GTACGGGAGATTACAATGCAAATATTGAAGCATTTAAAACAGTCGCTAAAGC
AGTTGGCAAAGAGAAGAAGGCGAAAAGCGTCTGGAAAAGCATAATAAAAT
ATTAGCGGAGATTAGAAAGAAAATTGAACAGAGTACGTTAAAATCTGCATTT
GCATTTGGTATCTCAAGAGCAGGTATGTTTATTAATAATGAAGATACATTTAT
GGGACAATTCTTAATTAAAATGGGTATTCAACCTGAAGTCACAAAAGACAAA
ACTGCGCATGTTGGTGAACGCAAGGGTGGCCCTTATATTTATTTAAATAATGA
AGAGCTTGCCAATATCAATCCAAAAGTTATGATTTTAGCTACGAATGGAAAAA
CAGATAAAAATAGAACGAAATTCATTGATCCTGCAGTTTGGAAATCATTAAAA
GCTGTGAAAGATAATAAAGTATATGATGTTGATCGAAATAAGTGGTTGCAATC
AAGAGGTATTATGGCAAGTGAAAGTATGGCAGAAGATTTAGAAAAAATTGCA
GAAAAAGCAAAATAA (SEQ ID NO:477)

Figure 132

GTGAATAGGAATATCGTTAAACTAGTTGTGTTTATGCTAATCTTAGTTGTAGCA
GTAGCGGGTTGTGGTCAAAAAGATACTGAAGAGAAAACTGAAATGACGACAA
TAAAAGATGAATTAGGAACTGAAAAAATTAAGAAAAATCCTAAACGTGTTGT
TGTATTAGAATATAGTTTTGCTGATTATTTAGCAGCATTAGATATGAAACCTGT
TGGTATTGCAGATGATGGCAGCAGTAAAAATATAACAAAGTCAGTAAGAGAT
AAGATTGGGGCATATGAATCGGTTGGATCTAGACCGCAACCGAATATGGAAG
TGATAAGTAAATTAAAACCGGATTTGATCATTGCAGATGTTAGCAGACATAAG
AAAATCAAATCAGAATTGAGCAAAATTGCGCCGACAATTATGTTAGTCAGTGG
TACGGGAGATTACAATGCAAATATTGAAGCATTTAAAACAGTCGCTAAAGCA
GTTGGCAAAGAGAAAGAAGGCGAGAAGCGTCTGGAAAAGCATGATAAAATAT
TAGCGGAGATTAGAAAGAAAATTGAACAGAGTACGTTAAAATCTGCATTTGC
ATTCGGTATCTCAAGAGCAGGTATGTTTATTAATAATGAAGATACATTTATGG
GACAATTCTTACTTAAAATGGGTATTCAACCTGAAGTCACAAAAGACAAAACT
ACGCATGTTGGTGAACGCAAGGGTGGTCCTTATATATATTTAAATAATGAAGA
ACTTGCCAATATCAATCCAAAAGTTATGATTTTAGCCACTGACGGGAAAACGG
ACAAAAATAGAACGAAATTCATTGATCCTGCAGTTTGGAAATCATTAAAAGCT
GTGAAAGATAACAAAGTTTATGACGTTGACCGAAATAAGTGGTTGAAATCAA
GGGGGATTATCGCAAGTGAAAGTATGGCAGAAGATTTAGAAAAAATTGCAGA
AAAAGCAAAATAA
(SEQ ID NO:478)

Figure 133

GTGAATAGGAATATCGTTAAACTAGTTGTGTTCATGCTAATTTTAGTTGTAGCA
GTAGCGGGTTGTGGTCAAAAAGATACTGAAGAGAAAACTGAAATGACGACAA
TAAAAGATGAATTAGGAACTGAAAAAATTAAGAAAAATCCTAAACGTGTTGT
TGTATTAGAATATAGTTTTGCTGATTATTTAGCAGCATTAGATATGAAACCTGT
TGGTATTGCAGATGATGGCAGCACTAAAAATATAACAAAGTCAGTAAGAGAT
AAGATTGGGGCATATGAATCGGTTGGATCTAGACCGCAACCGAATATGGAAG
TGATAAGTAAATTAAAACCGGATTTGATCATTGCAGATGTTAGCAGACATAAG
AAAATCAAATCAGAATTGAGCAAAATTGCTCCGACAATCATGTTAGTTAGCGG
TACGGGAGATTATAATGCAAATATTGAAGCATTTAAAACAGTCGCTAAAGCA
GTAGGCAAAGAGAAAGAAGGCGAGAAGCGTCTGGAAAAGCATGATAAAATA
TTAGCGGAGATTAGAAAGAAAATTGAACAGAGTACGTTAAAATCTGCATTTGC
ATTCGGTATCTCAAGAGCAGGTATGTTTATTAATAATGAAGATACATTTATGG
GACAATTCTTAATTAAAATGGGTATTCAACCTGAAGTCACAAAAGACAAAACT
ACGCATGTTGGTAACGCAAGGGTGGTCCTTATATATATTTAAATAATGAAGA
ACTTGCCAATATCAATCCAAAAGTTATGATTTTAGCCACTGACGGAAAAACGG
ACAAAAATAGAACGAAATTCATTGATCCTGCAGTTTGGAAATCATTAAAAGCT
GTGAAAGATAACAAAGTTTATGACGTTGACCGAAATAAGTGGTTGAAATCAA
GGGGGATTATCGCAAGTGAAAGTATGGCAGAAGATTTAGAAAAAATTGCAGA
AAAAGCAAAATAA
(SEQ ID NO:479)

Figure 134

GTGAATAGGAATATCGTTAAATTAGTTGTGTTTATGCTAATCTTAGTTGTAGCA
GTAGCGGGTTGTGGTCAAAAAGATACTGAAGAGAAAACTGAAATGACGACAA
TAAAAGATGAATTAGGAACTGAAAAAATTAAGAAAAATCCTAAACGTGTTGT
TGTATTAGAATATAGTTTTGCTGATTATTTAGCAGCATTAGATATGAAACCTGT
TGGTATTGCAGATGATGGCAGCACTAAAAATATAACAAAGTCAGTAAGAGAT
AAGATTGGGGCATATGAATCGGTTGGATCTAGACCGCAACCGAATATGGAAG
TGATAAGTAAATTAAAACCGGATTTGATCATTGCAGATGTTAGCAGACATAAG
AAAATCAAATCAGAATTGAGCAAAATTGCTCCGACAATCATGTTAGTTAGCGG
TACGGGAGATTATAATGCAAATATTGAAGCATTTAAAACAGTCGCTAAAGCA
GTAGGCAAAGAGAAAGAAGGCGAGAAGCGTCTGGAAAGCATGATAAAATA
TTAGCGGAGATTAGAAAGAAAATTGAACAGAGTACGTTAAAATCTGCATTTGC
ATTCGGTATCTCAAGAGCAGGTATGTTTATTAATAATGAAGATACATTTATGG
GACAATTCTTAATTAAATGGGTATTCAACCTGAAGTCACAAAAGACAAAACT
ACGCATGTTGGTGAACGCAAGGGTGGTCCTTATATATATTTAAATAATGAAGA
ACTTGCCAATATCAATCCAAAAGTTATGATTTTAGCCACTGACGGAAAAACGG
ACAAAAATAGAACGAAATTCATTGATCCTGCAGTTTGGAAATCATTAAAAGCT
GTGAAAGATAACAAAGTTTATGACGTTGACCGAAATAAGTGGTTGAAATCAA
GGGGGATTATCGCAAGTGAAAGTATGGCAGAAGATTTAGAAAAAATTGCAGA
AAAAGCAAAATAA
(SEQ ID NO:480)

Figure 135

ATGACGACAATAAAAGATGAATTAGGAACTGAAAAAATTAAGAAAAATCCTA
AACGTGTTGTTGTATTAGAATATAGTTTTGCTGATTATTTAGCAGCATTAGATA
TGAAACCTGTTGGTATTGCAGATGATGGCAGCACTAAAAATATAACAAAGTCA
GTAAGAGATAAGATTGGGGCATATGAATCGGTTGGATCTAGACCGCAACCGA
ATATGGAAGTGATAAGTAAATTAAAACCGGATTTGATCATTGCAGATGTTAGC
AGACATAAGAAAATCAAATCAGAATTGAGCAAAATTGCTCCGACAATCATGT
TAGTTAGCGGTACGGGAGATTATAATGCAAATATTGAAGCATTTAAAACAGTC
GCTAAAGCAGTAGGCAAAGAGAAAGAAGGCGAGAAGCGTCTGGAAAAGCAT
GATAAAATATTAGCGGAGATTAGAAAGAAAATTGAACAGAGTACGTTAAAAT
CTGCATTTGCATTCGGTATCTCAAGAGCAGGTATGTTTATTAATAATGAAGAT
ACATTTATGGGACAATTCTTAATTAAAATGGGTATTCAACCTGAAGTCACAAA
AGACAAAACTACGCATGTTGGTGAACGCAAGGGTGGTCCTTATATATATTTAA
ATAATGAAGAACTTGCCAATATCAATCCAAAAGTTATGATTTAGCCACTGAC
GGAAAAACGGACAAAATAGAACGAAATTCATTGATCCTGCAGTTTGGAAAT
CATTAAAAGCTGTGAAAGATAACAAAGTTTATGACGTTGACCGAAATAAGTG
GTTGAAATCAAGGGGGATTATCGCAAGTGAAAGTATGGCAGAAGATTTAGAA
AAAATTGCAGAAAAGCAAAATAA (SEQ ID NO:481)

Figure 136

GTGAATAGGAATATCGTTAAACTAGTTGTGTTCATGCTAATTTTAGTTGTAGCA
GTAGCGGGTTGTGGTCAAAAAGATACTGAAGAGAAAACTGAAATGACGACAA
TAAAAGATGAATTAGGAACTGAAAAATTAAGAAAATCCTAAACGTGTTGT
TGTATTAGAATATAGTTTTGCTGATTATTTAGCAGCATTAGATATGAAACCTGT
TGGTATTGCAGATGATGGCAGCACTAAAAATATAACAAAGTCAGTAAGAGAT
AAGATTGGGGCATATGAATCGGTTGGATCTAGACCGCAACCGAATATGGAAG
TGATAAGTAAATTAAAACCGGATTTGATCATTGCAGATGTTAGCAGACATAAG
AAAATCAAATCAGAATTGAGCAAAATTGCTCCGACAATCATGTTAGTTAGCGG
TACGGGAGATTATAATGCAAATATTGAAGCATTTAAAACAGTCGCTAAAGCA
GTAGGCAAAGAGAAAGAAGGCGAGAAGCGTCTGGAAAAGCATGATAAAATA
TTAGCGGAGATTAGAAAGAAAATTGAACAGAGTACGTTAAAATCTGCATTTGC
ATTCGGTATCTCAAGAGCAGGTATGTTTATTAATAATGAAGATACATTTATGG
GACAATTCTTAATTAAAATGGGTATTCAACCTGAAGTCACAAAAGACAAAACT
ACGCATGTTGGTGAACGCAAGGGTGGTCCTTATATATATTTAAATAATGAAGA
ACTTGCCAATATCAATCCAAAAGTTATGATTTTAGCCACTGACGGAAAAACGG
ACAAAAATAGAACGAAATTCATTGATCCTGCAGTTTGGAAATCATTAAAAGCT
GTGAAAGATAACAAAGTTTATGACGTTGACCGAAATAAGTGGTTGAAATCAA
GGGGGATTATCGCAAGTGAAAGTATGGCAGAAGATTTAGAAAAAATTGCAGA
AAAAGCAAAATAA (SEQ ID NO:482)

Figure 137

ATGACGACAATAAAAGATGAATTAGGAACTGAAAAAATTAAGAAAAATCCTA
AACGTGTTGTTGTATTAGAATATAGTTTTGCTGATTATTTAGCAGCATTAGATA
TGAAACCTGTTGGTATTGCAGATGATGGCAGCACTAAAAATATAACAAAGTCA
GTAAGAGATAAGATTGGGGCATATGAATCGGTTGGATCTAGACCGCAACCGA
ATATGGAAGTGATAAGTAAATTAAAACCGGATTTGATCATTGCAGATGTTAGC
AGACATAAGAAAATCAAATCAGAATTGAGCAAAATTGCTCCGACAATCATGT
TAGTTAGCGGTACGGGAGATTATAATGCAAATATTGAAGCATTTAAAACAGTC
GCTAAAGCAGTAGGCAAAGAGAAGAAGGCGAGAAGCGTCTGGAAAAGCAT
GATAAAATATTAGCGGAGATTAGAAAGAAAATTGAACAGAGTACGTTAAAAT
CTGCATTTGCATTCGGTATCTCAAGAGCAGGTATGTTTATTAATAATGAAGAT
ACATTTATGGGACAATTCTTAATTAAAATGGGTATTCAACCTGAAGTCACAAA
AGACAAAACTACGCATGTTGGTGAACGCAAGGGTGGTCCTTATATATATTTAA
ATAATGAAGAACTTGCCAATATCAATCCAAAAGTTATGATTTTAGCCACTGAC
GGAAAAACGGACAAAAATAGAACGAAATTCATTGATCCTGCAGTTTGGAAAT
CATTAAAAGCTGTGAAAGATAACAAAGTTTATGACGTTGACCGAAATAAGTG
GTTGAAATCAAGGGGGATTATCGCAAGTGAAAGTATGGCAGAAGATTTAGAA
AAAATTGCAGAAAAGCAAAATAA
(SEQ ID NO:483)

Figure 138

GTGAATAGGAATATCGTTAAACTAGTTGTGTTTATGCTAATCTTAGTTGTAGCA
GTAGCGGGTTGTGGTCAAAAAGATACTGAAGAGAAAACTGAAATGACGACAA
TAAAAGATGAATTAGGAACTGAAAAATTAAGAAAATCCTAAACGTGTTGT
TGTATTAGAATATAGTTTTGCTGATTATTTAGCAGCATTAGATATGAAACCTGT
TGGTATTGCAGATGATGGCAGCAGTAAAAATATAACAAAGTCAGTAAGAGAT
AAGATTGGGGCATATGAATCGGTTGGATCTAGACCGCAACCGAATATGGAAG
TGATAAGTAAATTAAAACCGGATTTGATCATTGCAGATGTTAGCAGACATAAG
AAAATCAAATCAGAATTGAGCAAAATTGCGCCGACAATTATGTTAGTCAGTGG
TACGGGAGATTACAATGCAAATATTGAAGCATTTAAAACAGTCGCTAAAGCA
GTTGGCAAAGAGAAAGAAGGCGAGAAGCGTCTGGAAAAGCATGATAAAATAT
TAGCGGAGATTAGAAAGAAAATTGAACAGAGTACGTTAAAATCTGCATTTGC
ATTCGGTATCTCAAGAGCAGGTATGTTTATTAATAATGAAGATACATTTATGG
GACAATTCTTACTTAAAATGGGTATTCAACCTGAAGTCACAAAAGACAAAACT
ACGCATGTTGGTGAACGCAAGGGTGGTCCTTATATATTTAAATAATGAAGA
ACTTGCCAATATCAATCCAAAAGTTATGATTTAGCCACTGACGGGAAAACGG
ACAAAAATAGAACGAAATTCATTGATCCTGCAGTTTGGAAATCATTAAAAGCT
GTGAAAGATAACAAAGTTTATGACGTTGACCGAAATAAGTGGTTGAAATCAA
GGGGGATTATCGCAAGTGAAAGTATGGCAGAAGATTTAGAAAAAATTGCAGA
AAAAGCAAAATAA
(SEQ ID NO:484)

Figure 139

GGTAGCGACGATAATGGCTCGTCTAAATCGCCGTACCATAGAATTGTTTCGTT
AATGCCTAGTAATACTGAAATTTTATATGAATTAGGATTAGGTAAATACATAG
TTGGTGTTTCAACGGTTGATGATTATCCAAAAGATGTGAAAAGGGTAAGAAA
CAATTTGATGCTTTGAATCTAAATAAAGAGGAACTTTTAAAGGCAAAGCCAGA
TCTAATTCTTGCGCATGAGTCGCAAAAGGCAACTGCAAATAAAGTATTGTCAT
CATTAGAGAAACAAGGCATCAAAGTAGTGTATGTTAAAGATGCACAATCAAT
TGATGAAACTTACAACACATTTAAGCAAATTGGGAAATTAACGCATCATGATA
AGCAGGCTGAACAACTTGTTGAGGAAACTAAAGATAATATCGATAAAGTCAT
AGATTCAATTCCTGCTCATCATAAAAAATCAAAAGTATTTATTGAGGTTTCATC
AAAGCCTGAAATATATACAGCAGGGAAGCATACATTTTCAATGATATGTTAG
AAAAATTAGAAGCCCAAAATGTTTATAGTGACATTAATGGTTGGAACCCTGTA
ACGAAGGAAAGTATTATTAAAAGAACCCAGATATATTAATTTCGACGGAAG
CTAAGACAAGATCAGATTATATGGATATCATCAAAAAAAGAGGTGGATTCAA
TAAAATTAATGCTGTCAAGAATACACGTATTGAAGTTGTAAATGGTGATGAAG
TGTCAAGACCAGGTCCACGTATTGATGAAGGATTAAAAGAATTAAGAGATGC
AATTTATAGAAAATAA
(SEQ ID NO:485)

Figure 140

GTGAAGAAATCGTTAATTGCTTTTATTTTGATTTTTATGCTTGTTCTGAGTGGC
TGTGGTATGAAAGATAATGATAAACAAGGTAGCGATGATAATGGCTCGTCTA
AATCGCCGTACCATAGAATTGTTTCGTTAATGCCTAGTAATACTGAAATTTAT
ATGAATTAGGATTAGGTAAATACATAGTTGGTGTTTCAACGGTTGATGATTAT
CCAAAAGATGTGAAAAGGGTAAGAAACAATTTGATGCTTTGAATCTAAATA
AAGAGGAACTTTTAAAGGCAAAGCCAGATCTAATTCTTGCGCATGAGTCGCAA
AAGGCAACTGCTAATAAAGTATTGTCATCATTAGAGAAACAAGGCATCAAAG
TAGTGTATATTAAAGATGCACAATCAATTGATGAAACTTACAACACATTTAAG
CAAATTGGGAAATTAACGCATCATGATAAGCAGGCTGAACAACTTGTTGAGG
AAACTAAAGATAATATCGATAAAGTCATAGATTCAATTCCTGCTCATCATAAA
AAATCAAAAGTATTTATTGAGGTTTCATCAAAGCCTGAAATATATACAGCAGG
GAAGCATACATTTTTCAATGATATGTTAGAAAAATTAGAAGCCCAAAATGTTT
ATAGTGACATTAATGGTTGGAACCCTGTAACGAAGGAAAGTATTATTAAAAA
GAACCCAGATATATTAATTTCGACGGAAGCTAAGACAAGATCAGATTATATGG
ATATCATCAAAAAAGAGGTGGATTCAATAAAATTAATGCTGTCAAGAATAC
ACGTATTGAAGTAGTAAATGGTGATGAAGTATCAAGACCAGGTCCACGTATTG
ATGAAGGATTAAAAGAATTAAGAGATGCAATTTATAGAAAATAA
(SEQ ID NO:486)

Figure 141

GTGAAGAAATCGTTAATTGCTTTTATTTTGATTTTTATGCTTGTCCTGAGTGGC
TGTGGTATGAAAGATAATGATAAACAAGGTAGCGATGATAATGGCTCGTCTA
AATCGCCGTACCATAGAATTGTTTCGTTAATGCCTAGTAATACTGAAATTTTAT
ATGAATTAGGATTAGGTAAATACATAGTTGGTGTTTCAACGGTTGATGATTAT
CCAAAAGATGTGAAAGAGGGTAAGAAACAATTTGATGCTTTGAATCTAAATA
AAGAGGAACTTTTAAAGGCAAAGCCAGATCTAATTCTTGCGCATGAGTCGCAA
AAGGCAACTGCTAATAAAGTATTGTCATCATTAGAGAAACAAGGCATCAAAG
TAGTGTATGTTAAAGATGCACAATCAATTGATGAAACATACAACACATTTAAG
CAAATTGGGAAATTAACGCATCATGATAAGCAGGCTGAACAACTTGTTGAGG
AAACTAAAGATAATATCGATAAAGTCATAGATTCAATTCCTGCTCATCATAAA
AAATCAAAAGTATTTATTGAGGTTTCATCAAAGCCTGAAATATATACAGCAGG
GAAGCATACATTTTTAATGATATGTTAGAAAAATTAGAAGCCCAAAATGTTT
ATAGTGACATTAATGGTTGGAACCCTGTAACGAAGGAAAGTATTATTAAAAA
GAACCCAGATATATTAATTTCGACGGAAGCTAAGACAAGATCAGATTATATGG
ATATCATCAAAAAAGGGGTGGATTCAATAAAATTAATGCTGTCAAGAATAC
ACGTATTGAAGTTGTAAATGGTGATGAAGTATCAAGACCAGGTCCACGTATTG
ATGAAGGATTAAAAGAATTAAGAGATGCAATTTATAGAAAATAA (SEQ ID NO:487)

Figure 142

GTGAAGAAATCGTTAATTGCTTTTATTTTGATTTTTATGCTTGTTCTGAGTGGC
TGTGGTATGAAAGATAATGATAAACAAGGTAGCGACGATAATGGCTCGTCTA
AATCGCCGTACCATAGAATTGTTTCGTTAATGCCTAGTAATACTGAAATTTTAT
ATGAATTAGGATTAGGTAAATACATAGTTGGTGTTTCAACGGTTGATGATTAT
CCAAAAGATGTGAAAAGGGTAAGAAACAATTTGATGCTTTGAATCTAAATA
AAGAGGAACTTTTAAAGGCAAAGCCAGATCTAATTCTTGCGCATGAGTCGCAA
AAGGCAACTGCTAATAAAGTATTGTCATCATTAGAGAAACAAGGCATCAAAG
TAGTGTATGTTAAAGATGCACAATCAATTGATGAAACTTACAACACATTTAAG
CAAATTGGGAAATTAACGCATCATGAAAGCAGGCTGAACAACTTGTTGAGG
AAACTAAGGATAATATCGATAAAGTCATAGATTCAATTCCTGCTCATCATAAA
AAATCAAAAGTATTTATTGAGGTTTCATCAAAGCCTGAAATATATACAGCAGG
GAAGCATACATTTTTCAATGATATGTTAGAAAAATTAGAAGCCCAAAATGTTT
ATAGTGACATTAATGGTTGGAACCCTGTAACGAAGGAAAGTATTATTAAAAA
GAACCCAGATATATTAATTTCGACGGAAGCTAAGACAAGATCAGATTATATGG
ATATCATCAAAAAAGAGGTGGATTCAATAAAATTAATGCTGTCAAGAATAC
ACGTATTGAAGTTGTAAATGGTGATGAAGTATCAAGACCGGGTCCACGTATTG
ATGAAGGATTAAAAGAATTAAGAGATGCAATTTATAGAAAATAA
(SEQ ID NO:488)

Figure 143

GTGAAGAAATCGTTAATTGCTTTTATTTTGATTTTTATGCTTGTCCTGAGTGGC
TGTGGTATGAAAGATAATGATAAACAAGGTAGCAATGATAATGGCTCGTCTA
AATCGCCGTACCATAGAATTGTTTCGTTAATGCCTAGTAATACTGAAATTTTAT
ATGAATTAGGATTAGGTAAATACATAGTTGGTGTTTCAACGGTTGATGATTAT
CCAAAAGATGTGAAAGAGGGTAAGAAACAATTTGATGCTTTGAATCTAAATA
AAGAGGAACTTTTAAAGGAAAAGCCAGATCTAATTCTTGCGCATGAGTCGCA
AAAGGCAACTGCTAATAAAGTATTGTCATCATTAGAGAAACAAGGCATCAAA
GTAGTGTATGTTAAAGATGCACAATCAATTGATGAAACATACAACACATTTAA
GCAAATTGGGAAATTAACGCATCATGATAAGCAGGCTGAACAACTTGTTGAG
GAAACTAAAGATAATATCGATAAAGTCATAGATTCAATTCCTGCTCATCATAA
AAAATCAAAAGTATTTATTGAGGTTTCATCAAAGCCTGAAATATATACAGCAG
GAAAGCATACATTTTTCAATGATATGTTAGAAAAATTAGAAGCCCAAAATGTT
TATAGTGACATTAATGGTTGGAACCCTGTAACGAAGGAAAGTATTATTAAAAA
GAACCCAGATATATTAATTTCGACGGAAGCTAAGACAAGATCAGATTATATGG
ATATCATCAAAAAAGAGGTGGATTCAATAAAATTAATGCTGTCAAGAATAC
ACGTATTGAAGTTGTAAATGGTGATGAAGTATCAAGACCCGGTCCACGTATTG
ATGAAGGATTAAAAGAATTAAGAGATGCAATTTATAGAAAATAA
(SEQ ID NO:489)

Figure 144

GTGAAGAAATCGTTAATTGCTTTTATTTTGATTTTTATGCTTGTCCTGAGTGGC
TGTGGTATGAAAGATAATGATAAACAAGGTAGCAATGATAATGGCTCGTCTA
AATCGCCGTACCATAGAATTGTTTCGTTAATGCCTAGTAATACTGAAATTTTAT
ATGAATTAGGATTAGGTAAATACATAGTTGGTGTTTCAACGGTTGATGATTAT
CCAAAAGATGTGAAAAGGGTAAGAAACAATTTGATGCTTTGAATCTAAATA
AAGAGGAACTTTTAAAGGCAAAGCCAGATCTAATTCTTGCGCATGAGTCGCAA
AAGGCAACTGCTAATAAAGTATTGTCATCATTAGAGAAACAAGGCATCAAAG
TAGTGTATGTTAAAGATGCACAATCAATTGATGAAACTTACAACACATTTAAG
CAAATTGGGAAATTAACGCATCATGATAAGCAGGCTGAACAACTTGTTGAGG
AAACTAAAGATAATATCGATAAAGTCATAGATTCAATTCCTGCTCATCATAAA
AAATCAAAAGTATTTATTGAGGTTTCATCAAAGCCTGAAATATATACAGCAGG
GAAGCATACATTTTTAATGATATGTTAGAAAAATTAGAAGCCCAAAATGTGT
ATAGTGACATTAATGGTTGGAACCCTGTAACGAAGGAAAGTATTATTAAAAA
GAACCCAGATATATTAATTTCGACGGAAGCTAAGACAAGATCAGATTATATGG
ATATCATCAAAAAAAGAGGTGGATTCAATAAAATTAATGCTGTCAAGAATAC
ACGTATTGAAGTTGTAAATGGTGATGAAGTATCAAGACCAGGTCCACGTATTG
ATGAAGGATTAAAAGAATTAAGAGATGCAATTTATAGAAAATAA
(SEQ ID NO:490)

Figure 145

GTGAAGAAATCGTTAATTGCTTTTATTTTGATTTTTATGCTTGTCCTGAGTGGC
TGTGGTATGAAAGATAATGATAAACAAGGTAGCGATGATAATGGCTCGTCTA
AATCGCCGTACCATAGAATTGTTTCGTTAATGCCTAGTAATACTGAAATTTTAT
ATGAATTAGGATTAGGTAAATACATAGTTGGTGTTTCAACGGTTGATGATTAT
CCAAAAGATGTGAAGAGGGTAAGAAACAATTTGATGCTTTGAATCTAAATA
AAGAGGAACTTTTAAAGGCAAAGCCAGATCTAATTCTTGCGCATGAGTCGCAA
AAGGCAACTGCTAATAAAGTATTGTCATCATTAGAGAAACAAGGCATCAAAG
TAGTGTATGTTAAAGATGCACAATCAATTGATGAAACATACAACACATTTAAG
CAAATTGGGAAATTAACGCATCATGATAAGCAGGCTGAACAACTTGTTGAGG
AAACTAAAGATAATATCGATAAAGTCATAGATTCAATTCCTGCTCATCATAAA
AAATCAAAAGTATTTATTGAGGTTTCATCAAAGCCTGAAATATATACAGCAGG
GAAGCATACATTTTTTAATGATATGTTAGAAAAATTAGAAGCCCAAAATGTTT
ATAGTGACATTAATGGTTGGAACCCTGTAACGAAGGAAAGTATTATTAAAAA
GAACCCAGATATATTAATTTCGACGGAAGCTAAGACAAGATCAGATTATATGG
ATATCATCAAAAAAAGGGGTGGATTCAATAAAATTAATGCTGTCAAGAATAC
ACGTATTGAAGTTGTAAATGGTGATGAAGTATCAAGACCAGGTCCACGTATTG
ATGAAGGATTAAAAGAATTAAGAGATGCAATTTATAGAAAATAA
(SEQ ID NO:491

Figure 146

ATGAAAGATAATGATAAACAAGGTAGCAATGATAATGGCTCGTCTAAATCGC
CGTACCATAGAATTGTTTCGTTAATGCCTAGTAATACTGAAATTTTATATGAAT
TAGGATTAGGTAAATACATAGTTGGTGTTTCAACGGTTGATGATTATCCAAAA
GATGTGAAAAGGGTAAGAAACAATTTGATGCTTTGAATCTAAATAAAGAGG
AACTTTTAAAGGCAAAGCCAGATCTAATTCTTGCGCATGAGTCGCAAAAGGCA
ACTGCTAATAAAGTATTGTCATCATTAGAGAAACAAGGCATCAAAGTAGTGTA
TGTTAAAGATGCACAATCAATTGATGAAACTTACAACACATTTAAGCAAATTG
GGAAATTAACGCATCATGATAAGCAGGCTGAACAACTTGTTGAGGAAACTAA
AGATAATATCGATAAAGTCATAGATTCAATTCCTGCTCATCATAAAAAATCAA
AAGTATTTATTGAGGTTTCATCAAAGCCTGAAATATATACAGCAGGGAAGCAT
ACATTTTTAATGATATGTTAGAAAAATTAGAAGCCCAAAATGTGTATAGTGA
CATTAATGGTTGGAACCCTGTAACGAAGGAAAGTATTATTAAAAAGAACCCA
GATATATTAATTTCGACGGAAGCTAAGACAAGATCAGATTATATGGATATCAT
CAAAAAAAGAGGTGGATTCAATAAAATTAATGCTGTCAAGAATACACGTATT
GAAGTTGTAAATGGTGATGAAGTATCAAGACCAGGTCCACGTATTGATGAAG
GATTAAAAGAATTAAGAGATGCAATTTATAGAAAATAA
(SEQ ID NO:492)

Figure 147

GTGAAGAAATCGTTAATTGCTTTTATTTTGATTTTTATGCTTGTCCTGAGTGGC
TGTGGTATGAAAGATAATGATAAACAAGGTAGCAATGATAATGGCTCGTCTA
AATCGCCGTACCATAGAATTGTTTCGTTAATGCCTAGTAATACTGAAATTTTAT
ATGAATTAGGATTAGGTAAATACATAGTTGGTGTTTCAACGGTTGATGATTAT
CCAAAAGATGTGAAAAGGGTAAGAAACAATTTGATGCTTTGAATCTAAATA
AAGAGGAACTTTTAAAGGCAAAGCCAGATCTAATTCTTGCGCATGAGTCGCAA
AAGGCAACTGCTAATAAAGTATTGTCATCATTAGAGAAACAAGGCATCAAAG
TAGTGTATGTTAAAGATGCACAATCAATTGATGAAACTTACAACACATTTAAG
CAAATTGGGAAATTAACGCATCATGATAAGCAGGCTGAACAACTTGTTGAGG
AAACTAAAGATAATATCGATAAAGTCATAGATTCAATTCCTGCTCATCATAAA
AAATCAAAAGTATTTATTGAGGTTTCATCAAAGCCTGAAATATATACAGCAGG
GAAGCATACATTTTTAATGATATGTTAGAAAAATTAGAAGCCCAAAATGTGT
ATAGTGACATTAATGGTTGGAACCCTGTAACGAAGGAAAGTATTATTAAAAA
GAACCCAGATATATTAATTTCGACGGAAGCTAAGACAAGATCAGATTATATGG
ATATCATCAAAAAAGAGGTGGATTCAATAAAATTAATGCTGTCAAGAATAC
ACGTATTGAAGTTGTAAATGGTGATGAAGTATCAAGACCAGGTCCACGTATTG
ATGAAGGATTAAAAGAATTAAGAGATGCAATTTATAGAAAATAA
(SEQ ID NO:493)

Figure 148

ATGAAAGATAATGATAAACAAGGTAGCAATGATAATGGCTCGTCTAAATCGC
CGTACCATAGAATTGTTTCGTTAATGCCTAGTAATACTGAAATTTTATATGAAT
TAGGATTAGGTAAATACATAGTTGGTGTTTCAACGGTTGATGATTATCCAAAA
GATGTGAAAAGGGTAAGAAACAATTTGATGCTTTGAATCTAAATAAAGAGG
AACTTTTAAAGGCAAAGCCAGATCTAATTCTTGCGCATGAGTCGCAAAAGGCA
ACTGCTAATAAAGTATTGTCATCATTAGAGAAACAAGGCATCAAAGTAGTGTA
TGTTAAAGATGCACAATCAATTGATGAAACTTACAACACATTTAAGCAAATTG
GGAAATTAACGCATCATGATAAGCAGGCTGAACAACTTGTTGAGGAAACTAA
AGATAATATCGATAAAGTCATAGATTCAATTCCTGCTCATCATAAAAAATCAA
AAGTATTTATTGAGGTTTCATCAAAGCCTGAAATATATACAGCAGGGAAGCAT
ACATTTTTAATGATATGTTAGAAAAATTAGAAGCCCAAAATGTGTATAGTGA
CATTAATGGTTGGAACCCTGTAACGAAGGAAAGTATTATTAAAAAGAACCCA
GATATATTAATTTCGACGGAAGCTAAGACAAGATCAGATTATATGGATATCAT
CAAAAAAAGAGGTGGATTCAATAAAATTAATGCTGTCAAGAATACACGTATT
GAAGTTGTAAATGGTGATGAAGTATCAAGACCAGGTCCACGTATTGATGAAG
GATTAAAAGAATTAAGAGATGCAATTTATAGAAAATAA (SEQ ID NO:494)

Figure 149

GTGAAGAAATCGTTAATTGCTTTTATTTTGATTTTTATGCTTGTCCTGAGTGGC
TGTGGTATGAAAGATAATGATAAACAAGGTAGCAATGATAATGGCTCGTCTA
AATCGCCGTACCATAGAATTGTTTCGTTAATGCCTAGTAATACTGAAATTTTAT
ATGAATTAGGATTAGGTAAATACATAGTTGGTGTTTCAACGGTTGATGATTAT
CCAAAAGATGTGAAGAGGGTAAGAAACAATTTGATGCTTTGAATCTAAATA
AAGAGGAACTTTTAAAGGAAAAGCCAGATCTAATTCTTGCGCATGAGTCGCA
AAAGGCAACTGCTAATAAAGTATTGTCATCATTAGAGAAACAAGGCATCAAA
GTAGTGTATGTTAAAGATGCACAATCAATTGATGAAACATACAACACATTTAA
GCAAATTGGGAAATTAACGCATCATGATAAGCAGGCTGAACAACTTGTTGAG
GAAACTAAAGATAATATCGATAAAGTCATAGATTCAATTCCTGCTCATCATAA
AAAATCAAAAGTATTTATTGAGGTTTCATCAAAGCCTGAAATATATACAGCAG
GAAAGCATACATTTTTCAATGATATGTTAGAAAAATTAGAAGCCCAAAATGTT
TATAGTGACATTAATGGTTGGAACCCTGTAACGAAGGAAAGTATTATTAAAAA
GAACCCAGATATATTAATTTCGACGGAAGCTAAGACAAGATCAGATTATATGG
ATATCATCAAAAAAGAGGTGGATTCAATAAAATTAATGCTGTCAAGAATAC
ACGTATTGAAGTTGTAAATGGTGATGAAGTATCAAGACCCGGTCCACGTATTG
ATGAAGGATTAAAAGAATTAAGAGATGCAATTTATAGAAAATAA (SEQ ID NO:495)

Figure 150

AGTGATAAGTCAAATGGCAAACTAAAAGTAGTAACGACGAATTCAATTTTATA
TGATATGGCTAAAAATGTTGGTGGAGACAACGTCGATATTCATAGTATTGTAC
CTGTTGGTCAAGATCCTCATGAATATGAAGTTAAACCTAAAGATATTAAAAAG
TTAACTGACGCTGACGTTATTTTATACAACGGATTAAATTTAGAGACTGGTAA
CGGTTGGTTTGAAAAAGCCTTAGAACAGGCTGGTAAATCATTAAAAGATAAA
AAAGTTATCGCAGTATCAAAAGATGTTAAACCTATCTATTTAAACGGTGAAGA
AGGCAACAAAGATAAACAAGATCCACACGCATGGTTAAGTTTAGATAACGGT
ATTAAATACGTAAAAACAATTCAACAAACATTTATCGATAACGACAAAAAAC
ATAAAGCAGATTATGAAAGCAAGGTAACAAATACATTGCTCAATTGGAAAA
ATTAAATAATGACAGTAAAGACAAATTTAATGACATTCCAAAAGAACAACGT
GCCATGATTACAAGTGAAGGTGCCTTCAAGTACTTCTCAAAACAATACGGTAT
TACACCAGGTTATATTTGGGAAATTAACACTGAAAAACAAGGTACACCAGAA
CAAATGAGACAAGCTATTGAGTTTGTTAAAAAGCACAAATTAAAACACTTATT
AGTAGAAACAAGTGTTGATAAGAAAGCAATGGAAAGTTTATCTGAAGAAACG
AAGAAAGATATCTTTGGTGAAGTGTACACAGATTCAATCGGTAAAGAAGGCA
CTAAAGGTGACTCTTACTACAAAATGATGAAATCAAATATTGAAACTGTACAC
GGAAGCATGAAATAA (SEQ ID NO:496)

Figure 151

ATGAAAAAATTAGTACCTTTATTATTAGCCTTATTACTTCTAGTTGCTGCATGT
GGTACTGGTGGTAAACAAAGCAGTGATAAGTCAAATGGCAAATTAAAAGTAG
TAACGACGAATTCAATTTTATATGATATGGCTAAAAATGTTGGTGGAGACAAC
GTCGATATTCATAGTATTGTACCTGTTGGTCAAGATCCTCATGAATATGAAGTT
AAACCTAAAGATATTAAAAAGTTAACTGACGCTGACGTTATTTTATACAACGG
ATTAAATTTAGAGACTGGTAACGGTTGGTTTGAAAAAGCCTTAGAACAGGCTG
GTAAATCATTAAAAGATAAAAAGTTATCGCAGTATCAAAAGATGTTAAACCT
ATCTATTTAAACGGTGAAGAAGGCAACAAAGATAAACAAGATCCACACGCAT
GGTTAAGTTTAGATAACGGTATTAAATACGTAAAAACAATTCAACAAACATTT
ATCGATAACGACAAAAAACATAAAGCAGATTATGAAAGCAAGGTAACAAAT
ACATTGCTCAATTGGAAAAATTAAATAATGACAGTAAAGACAAATTTAATGAC
ATTCCAAAAGAACAACGTGCCATGATTACAAGTGAAGGTGCCTTCAAGTACTT
CTCAAAACAATACGGTATTACACCAGGTTATATTTGGGAAATTAACACTGAAA
AACAAGGTACACCAGAACAAATGAGACAAGCTATTGAGTTTGTTAAAAAGCA
CAAATTAAAACACTTATTAGTAGAAACAAGTGTTGATAAGAAAGCAATGGAA
AGTTTATCTGAAGAAACGAAGAAAGATATCTTTGGTGAAGTGTACACAGATTC
AATCGGTAAAGAAGGCACTAAAGGTGACTCTTACTACAAAATGATGAAATCA
AATATTGAAACTGTACACGGAAGCATGAAATAA (SEQ ID NO:497)

Figure 152

ATGAAAAAATTAGTACCTTTATTATTAGCCTTATTACTTCTAGTTGCTGCATGT
GGTACTGGTGGTAAACAAAGCAGTGATAAGTCAAATGGCAAATTAAAAGTAG
TAACGACGAATTCAATTTTATATGATATGGCTAAAAATGTTGGTGGAGACAAC
GTCGATATTCATAGTATTGTACCTGTTGGTCAAGATCCTCATGAATATGAAGTT
AAACCTAAAGATATTAAAAAGTTAACTGACGCTGACGTTATTTTATACAACGG
ATTAAATTTAGAGACTGGTAACGGTTGGTTTGAAAAAGCCTTAGAACAGGCTG
GTAAATCATTAAAAGATAAAAAGTTATCGCAGTATCAAAGATGTTAAACCT
ATCTATTTAAACGGTGAAGAAGGCAACAAAGATAAACAAGATCCACACGCAT
GGTTAAGTTTAGATAATGGTATTAAATACGTAAAAACAATTCAACAAACATTT
ATCGATAACGACAAAAAACATAAAGCAGATTATGAAAGCAAGGTAACAAAT
ACATTGCTCAATTGGAAAAATTAAATAATGACAGTAAAGACAAATTTAATGAC
ATTCCAAAAGAACAACGTGCCATGATTACAAGTGAAGGTGCCTTCAAGTACTT
CTCAAAACAATACGGTATTACACCAGGTTATATTTGGGAAATTAACACTGAAA
AACAAGGTACACCTGAACAAATGAGACAAGCTATTGAGTTTGTTAAAAAGCA
CAAATTAAAACACTTATTAGTAGAAACAAGTGTTGATAAGAAAGCAATGGAA
AGTTTATCTGAAGAAACGAAGAAAGATATCTTTGGTGAAGTGTACACAGATTC
AATCGGTAAAGAAGGCACTAAAGGTGACTCTTACTACAAAATGATGAAATCA
AATATTGAAACTGTACACGGAAGCATGAAATAA (SEQ ID NO:498)

Figure 153

ATGAAAAAATTAGTACCTTTATTATTAGCCTTATTACTTTTAGTTGCTGCATGT
GGTACTGGTGGTAAACAAAGCAGTGATAAGTCAAATGGCAAACTAAAAGTAG
TAACGACGAATTCAATTTTATATGATATGGCTAAAAATGTTGGTGGAGACAAC
GTCGATATTCATAGTATTGTACCTGTTGGTCAAGATCCTCATGAATATGAAGTT
AAACCTAAAGATATTAAAAGTTAACTGACGCTGACGTTATTTTATACAACGG
ATTAAATTTAGAGACTGGTAACGGTTGGTTTGAAAAAGCCTTAGAACAGGCTG
GTAAATCATTAAAAGATAAAAAGTTATCGCAGTATCAAAAGATGTTAAACCT
ATCTATTTAAACGGTGAAGAAGGCAACAAAGATAAACAAGATCCACACGCAT
GGTTAAGTTTAGATAACGGTATTAAATACGTAAAAACAATTCAACAAACATTT
ATCGATAACGACAAAAAACATAAAGCAGATTATGAAAGCAAGGTAACAAAT
ACATTGCTCAATTGGAAAAATTAAATAACGACAGTAAAGACAAATTTAATGA
CATTCCAAAAGAACAACGTGCCATGATTACAAGTGAAGGTGCCTTCAAGTACT
TCTCAAAACAATACGGTATTACACCAGGTTATATTTGGGAAATTAACACTGAA
AAACAAGGTACACCAGAACAAATGAGACAAGCTATTGAGTTTGTTAAAAAGC
ACAAATTAAAACACTTATTAGTAGAAACAAGTGTTGATAAGAAAGCAATGGA
AAGTTTATCTGAAGAAACGAAGAAAGATATCTTTGGTGAAGTGTACACAGATT
CAATCGGTAAAGAAGGCACTAAAGGTGACTCTTACTACAAAATGATGAAATC
AAATATTGAAACTGTACACGGAAGCATGAAATAA (SEQ ID NO:499)

Figure 154

ATGAAAAAATTAGTACCTTTATTATTAGCCTTATTACTTCTAGTTGCTGCATGT
GGTACTGGTGGTAAACAAAGCAGTGATAAGTCAAATGGCAAATTAAAAGTAG
TAACGACGAATTCAATTTTATATGATATGGCTAAAAATGTTGGTGGAGACAAC
GTCGATATTCATAGTATTGTACCTGTTGGTCAAGATCCTCATGAATATGAAGTT
AAACCTAAAGATATTAAAAAGTTAACTGACGCTGACGTTATTTTATACAACGG
ATTAAATTTAGAGACTGGTAACGGTTGGTTTGAAAAAGCCTTAGAACAGGCTG
GTAAATCATTAAAAGATAAAAAGTTATCGCAGTATCAAAGATGTTAAACCT
ATCTATTTAAACGGTGAAGAAGGCAACAAAGATAAACAAGATCCACACGCAT
GGTTAAGTTTAGATAACGGTATTAAATACGTAAAAACAATTCAACAAACATTT
ATCGATAACGACAAAAACATAAAGCAGATTATGAAAGCAAGGTAACAAAT
ACATTGCTCAATTGGAAAAATTAAATAATGACAGTAAAGACAAATTTAATGAC
ATTCCAAAAGAACAACGTGCCATGATTACAAGTGAAGGTGCCTTCAAGTACTT
CTCAAAACAATACGGTATTACACCAGGTTATATTTGGGAAATTAACACTGAAA
AACAAGGTACACCTGAACAAATGAGACAAGCTATTGAGTTTGTTAAAAAGCA
CAAATTAAAACACTTATTAGTAGAAACAAGTGTTGATAAGAAAGCAATGGAA
AGTTTATCTGAAGAAACGAAGAAAGATATCTTTGGTGAAGTGTACACAGATTC
AATCGGTAAAGAAGGCACTAAAGGTGACTCTTACTACAAAATGATGAAATCA
AATATTGAAACTGTACACGGAAGCATGAAATAA
(SEQ ID NO:500)

Figure 155

ATGAAAAAATTAGTACCTTTATTATTAGCCTTATTACTTCTAGTTGCTGCATGT
GGTACTGGTGGTAAACAAAGCAGTGATAAGTCAAATGGCAAATTAAAAGTAG
TAACGACGAATTCAATTTTATATGATATGGCTAAAAATGTTGGTGGAGACAAC
GTCGATATTCATAGTATTGTACCTGTTGGTCAAGATCCTCATGAATATGAAGTT
AAACCTAAAGATATTAAAAAGTTAACTGACGCTGACGTTATTTTATACAACGG
ATTAAATTTAGAGACTGGTAACGGTTGGTTTGAAAAAGCCTTAGAACAGGCTG
GTAAATCATTAAAAGATAAAAAGTTATCGCAGTATCAAAGATGTTAAACCT
ATCTATTTAAACGGTGAAGAAGGCAACAAAGATAAACAAGATCCACACGCAT
GGTTAAGTTTAGATAACGGTATTAAATACGTAAAAACAATTCAACAAACATTT
ATCGATAACGACAAAAAACATAAAGCAGATTATGAAAGCAAGGTAACAAAT
ACATTGCTCAATTGGAAAAATTAAATAATGACAGTAAAGACAAATTTAATGAC
ATTCCAAAAGAACAACGTGCCATGATTACAAGTGAAGGTGCCTTCAAGTACTT
CTCAAAACAATACGGTATTACACCAGGTTATATTTGGGAAATTAACACTGAAA
AACAAGGTACACCTGAACAAATGAGACAAGCTATTGAGTTTGTTAAAAAGCA
CAAATTAAAACACTTATTAGTAGAAACAAGTGTTGATAAGAAAGCAATGGAA
AGTTTATCTGAAGAAACGAAGAAAGATATCTTTGGTGAAGTGTACACAGATTC
AATCGGTAAAGAAGGCACTAAAGGTGACTCTTACTACAAAATGATGAAATCA
AATATTGAAACTGTACACGGAAGCATGAAATAA
(SEQ ID NO:501)

Figure 156

ATGAAAAAATTAGTACCTTTATTATTAGCCTTATTACTTCTAGTTGCTGCATGT
GGTACTGGTGGTAAACAAAGCAGTGATAAGTCAAATGGCAAATTAAAAGTAG
TAACGACGAATTCAATTTTATATGATATGGCTAAAAATGTTGGTGGAGACAAC
GTCGATATTCATAGTATTGTACCTGTTGGTCAAGATCCTCATGAATATGAAGTT
AAACCTAAAGATATTAAAAGTTAACTGACGCTGACGTTATTTTATACAACGG
ATTAAATTTAGAGACTGGTAACGGTTGGTTTGAAAAGCCTTAGAACAGGCTG
GTAAATCATTAAAGATAAAAAGTTATCGCAGTATCAAAAGATGTTAAACCT
ATCTATTTAAACGGTGAAGAAGGCAACAAAGATAAACAAGATCCACACGCAT
GGTTAAGTTTAGATAATGGTATTAAATACGTAAAAACAATTCAACAAACATTT
ATCGATAACGACAAAAAACATAAAGCAGATTATGAAAGCAAGGTAACAAAT
ACATTGCTCAATTGGAAAAATTAAATAATGACAGTAAAGACAAATTTAATGAC
ATTCCAAAAGAACAACGTGCCATGATTACAAGTGAAGGTGCCTTCAAGTACTT
CTCAAAACAATACGGTATTACACCAGGTTATATTTGGGAAATTAACACTGAAA
AACAAGGTACACCTGAACAAATGAGACAAGCTATTGAGTTTGTTAAAAAGCA
CAAATTAAAACACTTATTAGTAGAAACAAGTGTTGATAAGAAAGCAATGGAA
AGTTTATCTGAAGAAACGAAGAAAGATATCTTTGGTGAAGTGTACACAGATTC
AATCGGTAAAGAAGGCACTAAAGGTGACTCTTACTACAAAATGATGAAATCA
AATATTGAAACTGTACACGGAAGCATGAAATAA
(SEQ ID NO:502)

Figure 157

ATGAAAAAATTAGTACCTTTATTATTAGCCTTATTACTTCTAGTTGCTGCATGT
GGTACTGGTGGTAAACAAAGCAGTGATAAGTCAAATGGCAAATTAAAAGTAG
TAACGACGAATTCAATTTTATATGATATGGCTAAAAATGTTGGTGGAGACAAC
GTCGATATTCATAGTATTGTACCTGTTGGTCAAGATCCTCATGAATATGAAGTT
AAACCTAAGATATTAAAAGTTAACTGACGCTGACGTTATTTTATACAACGG
ATTAAATTTAGAGACTGGTAACGGTTGGTTTGAAAAAGCCTTAGAACAGGCTG
GTAAATCATTAAAAGATAAAAAGTTATCGCAGTATCAAAAGATGTTAAACCT
ATCTATTTAAACGGTGAAGAAGGCAACAAAGATAAACAAGATCCACACGCAT
GGTTAAGTTTAGATAACGGTATTAAATACGTAAAAACAATTCAACAAACATTT
ATCGATAACGACAAAAAACATAAAGCAGATTATGAAAAGCAAGGTAACAAAT
ACATTGCTCAATTGGAAAAATTAAATAATGACAGTAAAGACAAATTTAATGAC
ATTCCAAAAGAACAACGTGCCATGATTACAAGTGAAGGTGCCTTCAAGTACTT
CTCAAAACAATACGGTATTACACCAGGTTATATTTGGGAAATTAACACTGAAA
AACAAGGTACACCTGAACAAATGAGACAAGCTATTGAGTTTGTTAAAAAGCA
CAAATTAAAACACTTATTAGTAGAAACAAGTGTTGATAAGAAAGCAATGGAA
AGTTTATCTGAAGAAACGAAGAAAGATATCTTTGGTGAAGTGTACACAGATTC
AATCGGTAAAGAAGGCACTAAAGGTGACTCTTACTACAAAATGATGAAATCA
AATATTGAAACTGTACACGGAAGCATGAAATAA (SEQ ID NO:503)

Figure 158

ATGAAAAAATTAGTACCTTTATTATTAGCCTTATTACTTCTAGTTGCTGCATGT
GGTACTGGTGGTAAACAAAGCAGTGATAAGTCAAATGGCAAATTAAAAGTAG
TAACGACGAATTCAATTTTATATGATATGGCTAAAAATGTTGGTGGAGACAAC
GTCGATATTCATAGTATTGTACCTGTTGGTCAAGATCCTCATGAATATGAAGTT
AAACCTAAAGATATTAAAAAGTTAACTGACGCTGACGTTATTTTATACAACGG
ATTAAATTTAGAGACTGGTAACGGTTGGTTTGAAAAAGCCTTAGAACAGGCTG
GTAAATCATTAAAAGATAAAAAGTTATCGCAGTATCAAAGATGTTAAACCT
ATCTATTTAAACGGTGAAGAAGGCAACAAAGATAAACAAGATCCACACGCAT
GGTTAAGTTTAGATAACGGTATTAAATACGTAAAAACAATTCAACAAACATTT
ATCGATAACGACAAAAAACATAAAGCAGATTATGAAAGCAAGGTAACAAAT
ACATTGCTCAATTGGAAAAATTAAATAATGACAGTAAAGACAAATTTAATGAC
ATTCCAAAAGAACAACGTGCCATGATTACAAGTGAAGGTGCCTTCAAGTACTT
CTCAAAACAATACGGTATTACACCAGGTTATATTTGGGAAATTAACACTGAAA
AACAAGGTACACCTGAACAAATGAGACAAGCTATTGAGTTTGTTAAAAAGCA
CAAATTAAAACACTTATTAGTAGAAACAAGTGTTGATAAGAAAGCAATGGAA
AGTTTATCTGAAGAAACGAAGAAAGATATCTTTGGTGAAGTGTACACAGATTC
AATCGGTAAAGAAGGCACTAAAGGTGACTCTTACTACAAAATGATGAAATCA
AATATTGAAACTGTACACGGAAGCATGAAATAA
(SEQ ID NO:504)

Figure 159

ATGAAAAAATTAGTACCTTTATTATTAGCCTTATTACTTCTAGTTGCTGCATGT
GGTACTGGTGGTAAACAAAGCAGTGATAAGTCAAATGGCAAATTAAAAGTAG
TAACGACGAATTCAATTTTATATGATATGGCTAAAAATGTTGGTGGAGACAAC
GTCGATATTCATAGTATTGTACCTGTTGGTCAAGATCCTCATGAATATGAAGTT
AAACCTAAAGATATTAAAAGTTAACTGACGCTGACGTTATTTATACAACGG
ATTAAATTTAGAGACTGGTAACGGTTGGTTTGAAAAAGCCTTAGAACAGGCTG
GTAAATCATTAAAAGATAAAAAGTTATCGCAGTATCAAAGATGTTAAACCT
ATCTATTTAAACGGTGAAGAAGGCAACAAAGATAAACAAGATCCACACGCAT
GGTTAAGTTTAGATAACGGTATTAAATACGTAAAAACAATTCAACAAACATTT
ATCGATAACGACAAAAAACATAAAGCAGATTATGAAAGCAAGGTAACAAAT
ACATTGCTCAATTGGAAAAATTAAATAATGACAGTAAAGACAGTAAAGACAA
ATTTAATGACATTCCAAAAGAACAACGTGCCATGATTACAAGTGAAGGTGCCT
TCAAGTACTTCTCAAAACAATACGGTATTACACCAGGTTATATTTGGGAAATT
AACACTGAAAAACAAGGTACACCTGAACAAATGAGACAAGCTATTGAGTTTG
TTAAAAAGCACAAATTAAAACACTTATTAGTAGAAACAAGTGTTGATAAGAA
AGCAATGGAAAGTTTATCTGAAGAAACGAAGAAAGATATCTTTGGTGAAGTG
TACACAGATTCAATCGGTAAAGAAGGCACTAAAGGTGACTCTTACTACAAAAT
GATGAAATCAAATATTGAAACTGTACACGGAAGCATGAAATAA
(SEQ ID NO:505)

Figure 160

ATGAAAAAATTAGTACCTTTATTATTAGCCTTATTACTTCTAGTTGCTGCATGT
GGTACTGGTGGTAAACAAAGCAGTGATAAGTCAAATGGCAAATTAAAAGTAG
TAACGACGAATTCAATTTTATATGATATGGCTAAAAATGTTGGTGGAGACAAC
GTCGATATTCATAGTATTGTACCTGTTGGTCAAGATCCTCATGAATATGAAGTT
AAACCTAAAGATATTAAAAAGTTAACTGACGCTGACGTTATTTTATACAACGG
ATTAAATTTAGAGACTGGTAACGGTTGGTTTGAAAAAGCCTTAGAACAGGCTG
GTAAATCATTAAAAGATAAAAAGTTATCGCAGTATCAAAGATGTTAAACCT
ATCTATTTAAACGGTGAAGAAGGCAACAAAGATAAACAAGATCCACACGCAT
GGTTAAGTTTAGATAACGGTATTAAATACGTAAAAACAATTCAACAAACATTT
ATCGATAACGACAAAAACATAAAGCAGATTATGAAAGCAAGGTAACAAAT
ACATTGCTCAATTGGAAAAATTAAATAATGACAGTAAAGACAAATTTAATGAC
ATTCCAAAAGAACAACGTGCCATGATTACAAGTGAAGGTGCCTTCAAGTACTT
CTCAAAACAATACGGTATTACACCAGGTTATATTTGGGAAATTAACACTGAAA
AACAAGGTACACCTGAACAAATGAGACAAGCTATTGAGTTTGTTAAAAAGCA
CAAATTAAAACACTTATTAGTAGAAACAAGTGTTGATAAGAAAGCAATGGAA
AGTTTATCTGAAGAAACGAAGAAAGATATCTTTGGTGAAGTGTACACAGATTC
AATCGGTAAAGAAGGCACTAAAGGTGACTCTTACTACAAAATGATGAAATCA
AATATTGAAACTGTACACGGAAGCATGAAATAA
(SEQ ID NO:506)

Figure 161
A
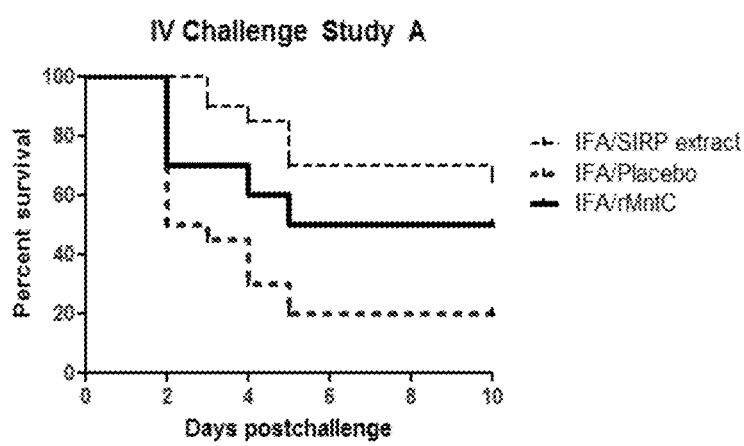
B
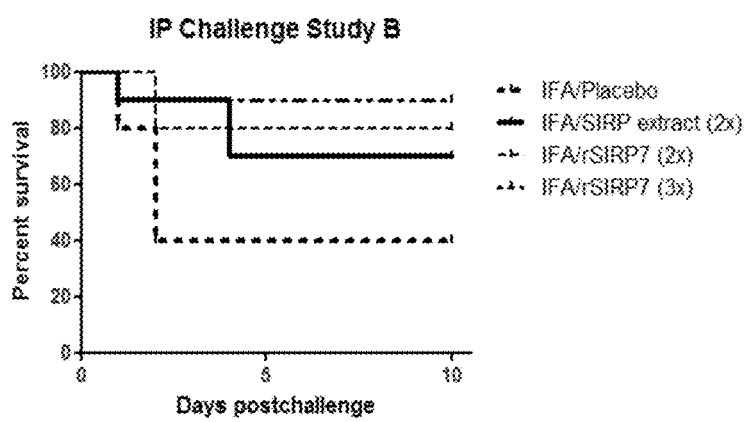
C
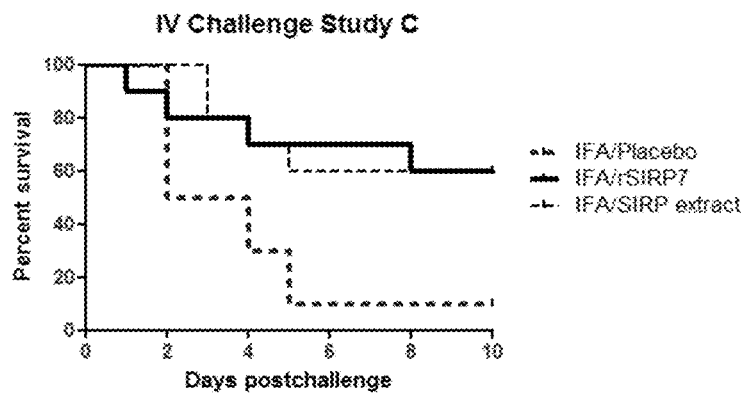

Figure 162

MKKTVLYLVLAVMFLLAACGNNSDKEQSKSETKGSKETVKIENNYKMRGEKKD
GSDAKKVKETVEVPKNPKNAVVLDYGALDVMKEMGLSDKVKALPNFLESFKDD
KYTNIGNLKEVNFDKIAATKPEVIFISGRTANQKNLDEFKKAAPKAKIVYVGADE
KNLIGSMKQNTENIGKIYDKEVKAKELNKDLDNKIASMKDKTKNFNKTVMYLLV
NEGELSTFGPKGRFGGLVYDTLGFNAVDKKVSNSNHGQNVSNEYVNKENPDVIL
AMDRGQAVSGKSTAKQALNNPVLKNVKAIKEDKVYNLDPKLWYFAAGSTTTTI
KQIEELDKVVK
(SEQ ID NO:543)

Figure 163

MKKTVLYLVLAVMFLLAACGNNSDKEQSKSETKGSKDTVKIENNYKMRGEKKD
GSDAKKVKETVEVPKNPKNAVVLDYGALDVMKEMGLSDKVKALPKGEGGKSLP
NFLESFKDDKYTNVGNLKEVNFDKIAATKPEVIFISGRTANQKNLDEFKKAAPKA
KIVYVGADEKNLIGSMKQNTENIGKIYDKEDKAKELNKDLDNKIASMKDKTKNF
NKTVMYLLVNEGELSTFGPKGRFGGLVYDTLGFNAVDKKVSNSNHGQNVSNEY
VNKENPDVILAMDRGQAISGKSTAKQALNNPVLKNVKAIKEDKVYNLDPKLWYF
AAGSTTTTIKQIEELDKVVK
(SEQ ID NO:544)

Figure 164

MKKTVLYLVVAVMFLLAACGNNSDKEQSKSETKGSKDTVKIENNYKMRGEKKD
GSDAKKVKETVEVPKNPKNAVVLDYGALDVMKEMGLSDKVKALPKGEGGKSLP
NFLESFKDDKYTNVGNLKEVNFDKIAATKPEVIFISGRTANQKNLDEFKKAAPKA
KIVYVGADEKNLISSMKQNTENIGKIYDKEDKAKELNKDLDNKIASMKDKTKKF
NKSVMYLLVNEGELSTFGPKGRFGGLVYDTLGFNAVDKNVSNSNHGQNVSNEYI
NKENPDVILAMDRGQAVSGKSTAKQALNNPVLKNVKAIKEDKVYNLDPKLWYF
AAGSTTTTIKQIDELEKVVK
(SEQ ID NO:545)

Figure 165
MKKTVLYLVLAVMFLLAACGNNSDKEQSKSETKGSKDTVKIENNYKMRGEKKD
GSDAKKVKETVEVPKNPKNAVVLDYGALDVMKEMGLSDKVKALPKGEGGKSLP
NFLESFKDDKYTNVGNLKEVNFDKIAATKPEVIFISGRTANQKNLDEFKKAAPKA
KIVYVGADEKNLIGSMKQNTENIGKIYDKEDKAKELNKDLDNKIASMKDKTKNF
NKTVMYLLVNEGELSTFGPKGRFGGLVYDTLGFNAVDKKVSNSNHGQNVSNEY
VNKENPDVILAMDRGQAISGKSTAKQALNNPVLKNVKAIKEDKVYNLDPKLWYF
AAGSTTTTIKQIEELDKVVK
(SEQ ID NO:546)

Figure 166
MKKTVLYLVLAVMFLLAACGNNSDKEQSKSETKGSKDTVKIENNYKMRGEKKD
GSDAKKVKETVEVPKNPKNAVVLDYGALDVMKEMGLSDKVKALPKGEGGKSLP
NFLESFKDDKYTNVGNLKEVNFDKIAATKPEVIFISGRTANQKNLDEFKKAAPKA
KIVYVGADEKNLIGSMKQNTENIGKIYDKEDKAKELNKDLDNKIASMKDKTKNF
NKTVMYLLVNEGELSTFGPKGRFGGLVYDTLGFNAVDKKVSNSNHGQNVSNEY
VNKENPDVILAMDRGQAISGKSTAKQALNNPVLKNVKAIKEDKVYNLDPKLWYF
AAGSTTTTIKQIEELDKVVK
(SEQ ID NO:547)

Figure 167
MKKTVLYLVLAVMFLLAACGNNSDKEQSKSETKGSKDTVKIENNYKMRGEKKD
GSDAKKVKETVEVPKNPKNAVVLDYGALDVMKEMGLSDKVKALPKGEGGKSLP
NFLESFKDDKYTNVGNLKEVNFDKIAATKPEVIFISGRTANQKNLDEFKKAAPKA
KIVYVGADEKNLIGSMKQNTENIGKIYDKEDKAKELNKDLDNKIASMKDKTKNF
NKTVMYLLVNEGELSTFGPKGRFGGLVYDTLGFNAVDKKVSNSNHGQNVSNEY
VNKENPDVILAMDRGQAISGKSTAKQALNNPVLKNVKAIKEDKVYNLDPKLWYF
AAGSTTTTIKQIEELDKVVK
(SEQ ID NO:548)

Figure 168

MKKTVLYLVLAVMFLLAACGNNSDKEQSKSETKGSKDTVKIENNYKMRGEKKD
GSDAKKVKETVEVPKNPKNAVVLDYGALDVMKEMGLSDKVKALPKGEGGKSLP
NFLESFKDDKYTNVGNLKEVNFDKIAATKPEVIFISGRTANQKNLDEFKKAAPKA
KIVYVGADEKNLIGSMKQNTENIGKIYDKEDKAKELNKDLDNKIASMKDKTKNF
NKTVMYLLVNEGELSTFGPKGRFGGLVYDTLGFNAVDKKVSNSNHGQNVSNEY
VNKENPDVILAMDRGQAISGKSTAKQALNNPVLKNVKAIKEDKVYNLDPKLWYF
AAGSTTTTIKQIEELDKVVK (SEQ ID NO:549)

Figure 169

MKKTVLYLVLAVMFLLAACGNNSDKEQSKSETKGSKDTVKIENNYKMRGEKKD
GSDAKKVKETVEVPKNPKNAVVLDYGALDVMKEMGLSDKVKALPKGEGGKSLP
NFLESFKDDKYTNVGNLKEVNFDKIAATKPEVIFISGRTANQKNLDEFKKAAPKA
KIVYVGADEKNLIGSMKQNTENIGKIYDKEDKAKELNKDLDNKIASMKDKTKNF
NKTVMYLLVNEGELSTFGPKGRFGGLVYDTLGFNAVDKKVSNSNHGQNVSNEY
VNKENPDVILAMDRGQAISGKSTAKQALNNPVLKNVKAIKEDKVYNLDPKLWYF
AAGSTTTTIKQIEELDKVVK (SEQ ID NO:550)

Figure 170

MKKTVLYLVLAVMFLLAACGNNSDKEQSKSETKGSKDTVKIENNYKMRGEKKD
GSDAKKVKETVEVPKNPKNAVVLDYGALDVMKEMGLSDKVKALPKGEGGKSLP
NFLESFKDDKYTNVGNLKEVNFDKIAATKPEVIFISGRTANQKNLDEFKKAAPKA
KIVYVGADEKNLIGSMKQNTENIGKIYDKEDKAKELNKDLDNKIASMKDKTKNF
NKTVMYLLVNEGELSTFGPKGRFGGLVYDTLGFNAVDKKVSNSNHGQNVSNEY
VNKENPDVILAMDRGQAISGKSTAKQALNNPVLKNVKAIKEDKVYNLDPKLWYF
AAGSTTTTIKQIEELDKVVK (SEQ ID NO:551)

Figure 171
MKKTVLYLVLAVMFLLAACGNNSDKEQSKSETKGSKDTVKIENNYKMRGEKKD
GSDAKKVKETVEVPKNPKNAVVLDYGALDVMKEMGLSDKVKALPKGEGGKSLP
NFLESFKDDKYTNVGNLKEVNFDKIAATKPEVIFISGRTANQKNLDEFKKAAPKA
KIVYVGADEKNLIGSMKQNTENIGKIYDKEDKAKELNKDLDNKIASMKDKTKNF
NKTVMYLLVNEGELSTFGPKGRFGGLVYDTLGFNAVDKKVSNSNHGQNVSNEY
VNKENPDVILAMDRGQAISGKSTAKQALNNPVLKNVKAIKEDKVYNLDPKLWYF
AAGSTTTTIKQIEELDKVVK
(SEQ ID NO:552)

Figure 172
MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTYGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:553)

Figure 173
MKKLLLPLIIMLLVLAACGNQGEKNNKAETKSYKMDDGKTVDIPKDPKRIAVVA
PTYAGGLKKLGANIVA
VNQQVDQSKVLKDKFKGVTKIGDGDVEKVAKEKPDLIIVYSTDKDIKKYQKVAP
TVVVDYNKHKYLEQQE
MLGKIVGKEDKVKAWKKDWEETTAKDGKEIKKAIGQDATVSLFDEFDKKLYTY
GDNWGRGGEVLYQAFGL
KMQPEQQKLTAKAGWAEVKQEEIEKYAGDYIVSTSEGKPTPGYESTNMWKNLK
ATKEGHIVKVDAGTYWY
NDPYTLDFMRKDLKEKLIKAAK
(SEQ ID NO:554)

Figure 174

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDIEKVAKEKPDLIIV
YSTDKDIKKYQKVAPTVVVDYNKHKYLEQQEMLGKIVGKEDKVKAWKKDWEE
TTAKDGKEIKKAIGQDATVSLFDEFDKKLYTYGDNWGRGGEVLYQAFGLKMQPE
QQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:555)

Figure 175

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTYGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:556)

Figure 176

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTYGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:557)

Figure 177

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTYGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:558)

Figure 178

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTYGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:559)

Figure 179

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTYGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK
(SEQ ID NO:560)

Figure 180

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK (SEQ ID NO:561)

Figure 181

MKKLLLPLIIMLLVLAACGNQGEKNNKAETKSYKMDDGKTVDIPKDPKRIAVVA
PTYAGGLKKLGANIVAVNQQVDQSKVLKDKFKGVTKIGDGDVEKVAKEKPDLII
VYSTDKDIKKYQKVAPTVVVDYNKHKYLEQQEMLGKIVGKEDKVKAWKKDWE
ETTAKDGKEIKKAIGQDATVSLFDEFDKKLYTGDNWGRGGEVLYQAFGLKMQP
EQQKLTAKAGWAEVKQEEIEKYAGDYIVSTSEGKPTPGYESTNMWKNLKATKEG
HIVKVDAGTYWYNDPYTLDFMRKDLKEKLIKAAK (SEQ ID NO:562)

Figure 182

ATGAAGAAAACAGTCTTATATTTAGTATTAGCAGTAATGTTTTTATTAGCGGC
ATGCGGTAACAATTCTGATAAAGAACAATCAAAATCAGAAACTAAAGGTTCA
AAAGAAACGGTTAAAATTGAAAATAACTATAAAATGCGTGGCGAGAAAAAAG
ATGGTAGTGACGCTAAAAAAGTTAAAGAAACTGTTGAAGTACCAAAGAATCC
TAAAAATGCAGTTGTGTTAGACTATGGCGCATTAGATGTAATGAAAGAAATGG
GCTTATCAGACAAAGTAAAAGCATTACCGAATTTCTTAGAATCATTTAAAGAT
GATAAATATACAAACATTGGTAATTTAAAAGAAGTGAATTTTGATAAAATTGC
TGCGACGAAACCCGAAGTAATCTTTATCTCTGGACGTACAGCTAATCAAAGA
ATTTAGATGAATTCAAAAAGCTGCACCTAAAGCGAAAATTGTTTATGTTGGT
GCAGATGAAAGAACTTAATTGGTTCAATGAAACAAAACACTGAAAATATCG
GTAAAATCTACGACAAAGAAGTCAAAGCTAAAGAGTTAAATAAAGATTTAGA
TAATAAAATTGCTTCAATGAAAGATAAAACGAAAAACTTCAATAAAACTGTTA
TGTATTTACTAGTTAACGAAGGTGAATTATCAACATTTGGACCTAAAGGTCGT
TTTGGTGGATTAGTTTACGATACATTAGGATTCAATGCAGTTGATAAAAAAGT
AAGTAATAGTAATCATGGACAAAATGTTTCTAACGAATATGTAAATAAAGAA
AATCCAGATGTTATTTAGCGATGGATAGAGGTCAAGCGGTAAGTGGTAAATC
AACTGCGAAACAAGCATTAAATAATCCTGTATTAAAAAATGTTAAAGCAATTA
AAGAAGACAAAGTTTATAATTTAGATCCTAAATTATGGTACTTTGCAGCTGGA
TCAACTACAACTACAATTAAACAAATTGAGGAACTTGATAAAGTTGTAAAATA
A (SEQ ID NO:563)

Figure 183

ATGAAGAAAACAGTCTTATATTTAGTATTAGCAGTAATGTTTTTATTAGCGGC
ATGCGGTAACAATTCTGATAAAGAACAATCAAAATCAGAAACTAAAGGTTCT
AAAGATACAGTAAAAATTGAAAATAACTATAAAATGCGTGGCGAGAAAAAG
ATGGTAGTGACGCTAAAAAGTTAAAGAAACTGTTGAAGTACCAAAAAATCC
TAAAAATGCAGTTGTGTTAGACTATGGCGCATTAGATGTAATGAAAGAAATGG
GCTTATCAGATAAAGTAAAAGCATTACCTAAAGGGGAAGGCGGTAAGTCATT
ACCGAATTTCTTAGAATCATTTAAAGATGATAAATATACAAACGTTGGTAATT
TAAAAGAAGTGAATTTTGATAAAATTGCTGCGACGAAACCCGAAGTAATCTTT
ATCTCTGGACGTACAGCTAATCAAAGAATTTAGATGAATTCAAAAAAGCTGC
ACCTAAAGCGAAAATTGTTTATGTTGGTGCAGATGAAAGAACTTAATTGGTT
CAATGAAACAAAACACTGAAAATATCGGTAAAATTTACGATAAGAAGATAA
AGCTAAAGAATTAAATAAAGATTTAGATAACAAAATTGCTTCAATGAAAGAT
AAAACGAAAAACTTCAATAAAACTGTTATGTATTTACTAGTTAACGAAGGTGA
ATTATCAACATTTGGACCTAAAGGTCGTTTTGGTGGATTAGTTTACGATACATT
AGGATTCAATGCAGTTGATAAAAAGTAAGTAATAGCAATCATGGACAAAAT
GTTTCTAACGAATATGTTAATAAGAAAATCCAGATGTTATTTTAGCGATGGA
TAGAGGTCAAGCGATAAGTGGTAAATCAACTGCGAAACAAGCATTAAATAAT
CCTGTATTAAAAAATGTTAAAGCAATTAAAGAAGACAAAGTATATAATTTAGA
TCCTAAATTATGGTACTTTGCAGCTGGATCAACTACAACTACAATTAAACAAA
TTGAGGAACTTGATAAAGTTGTAAAATAA (SEQ ID NO:564)

Figure 184

ATGAAGAAAACAGTCTTATATTTAGTAGTAGCAGTAATGTTTTTATTAGCGGC
ATGCGGTAACAATTCTGATAAAGAACAATCAAAATCAGAAACTAAAGGTTCT
AAAGATACAGTAAAAATTGAAAACAACTATAAAATGCGTGGCGAGAAAAAG
ATGGTAGCGATGCTAAAAAAGTTAAAGAAACTGTTGAAGTACCAAAGAACCC
TAAAAATGCAGTTGTATTAGATTATGGCGCATTAGATGTAATGAAAGAAATGG
GCTTATCAGACAAAGTAAAAGCATTACCTAAAGGTGAAGGCGGCAAGTCATT
ACCGAATTTCTTAGAGTCATTTAAAGATGACAAGTATACAAATGTTGGTAACT
TGAAAGAAGTTAATTTCGATAAAATTGCAGCAACAAAACCGGAAGTAATCTTT
ATCTCTGGCCGTACAGCAAATCAAAAGAATTTAGATGAATTTAAAAAAGCTGC
ACCAAAAGCAAAAATTGTTTACGTTGGTGCAGATGAAAGAATTTAATTAGTT
CAATGAAACAAAACACTGAAAATATTGGTAAAATTTACGATAAAGAAGATAA
AGCTAAAGAATTAAATAAAGATTTAGATAACAAAATTGCTTCAATGAAAGAT
AAAACTAAGAAGTTCAACAAATCAGTTATGTATTTATTAGTTAATGAAGGTGA
ATTATCAACATTTGGACCTAAAGGTCGTTTCGGTGGATTAGTTTACGATACATT
AGGTTTCAACGCGGTTGATAAAAACGTAAGCAATAGTAACCACGGACAAAAT
GTCTCTAACGAATACATTAATAAAGAAATCCAGATGTTATTTAGCAATGGA
TAGAGGACAGGCTGTAAGTGGTAAATCAACTGCGAAACAAGCATTAAATAAT
CCTGTATTAAAAAATGTTAAAGCAATTAAAGAAGACAAAGTTTATAATTTAGA
CCCTAAATTATGGTACTTTGCAGCTGGATCAACTACAACTACAATTAAACAAA
TTGATGAACTTGAAAAAGTTGTAAAATAA
(SEQ ID NO:565)

Figure 185

ATGAAGAAAACAGTCTTATATTTAGTATTAGCAGTAATGTTTTTATTAGCGGC
ATGCGGTAACAATTCTGATAAAGAACAATCAAAATCAGAAACTAAAGGTTCT
AAAGATACAGTAAAAATTGAAAATAACTATAAAATGCGTGGCGAGAAAAAG
ATGGTAGTGACGCTAAAAAAGTTAAAGAAACTGTTGAAGTACCAAAAAATCC
TAAAAATGCAGTTGTGTTAGACTATGGCGCATTAGATGTAATGAAAGAAATGG
GCTTATCAGATAAAGTAAAAGCATTACCTAAAGGGGAAGGCGGTAAGTCATT
ACCGAATTTCTTAGAATCATTTAAAGATGATAAATATACAAACGTTGGTAATT
TAAAAGAAGTGAATTTTGATAAAATTGCTGCGACGAAACCCGAAGTAATCTTT
ATCTCTGGACGTACAGCTAATCAAAGAATTTAGATGAATTCAAAAAAGCTGC
ACCTAAAGCGAAAATTGTTTATGTTGGTGCAGATGAAAGAACTTAATTGGTT
CAATGAAACAAAACACTGAAAATATCGGTAAAATTTACGATAAAGAAGATAA
AGCTAAAGAATTAAATAAAGATTTAGATAACAAAATTGCTTCAATGAAAGAT
AAAACGAAAAACTTCAATAAAACTGTTATGTATTTACTAGTTAACGAAGGTGA
ATTATCAACATTTGGACCTAAAGGTCGTTTTGGTGGATTAGTTTACGATACATT
AGGATTCAATGCAGTTGATAAAAAGTAAGTAATAGCAATCATGGACAAAAT
GTTTCTAACGAATATGTTAATAAAGAAAATCCAGATGTTATTTTAGCGATGGA
TAGAGGTCAAGCGATAAGTGGTAAATCAACTGCGAAACAAGCATTAAATAAT
CCTGTATTAAAAAATGTTAAAGCAATTAAAGAAGACAAAGTATATAATTTAGA
TCCTAAATTATGGTACTTTGCAGCTGGATCAACTACAACTACAATTAAACAAA
TTGAGGAACTTGATAAAGTTGTAAAATAA
(SEQ ID NO:566)

Figure 186

ATGAAGAAAACAGTCTTATATTTAGTATTAGCAGTAATGTTTTTATTAGCGGC
ATGCGGTAACAATTCTGATAAAGAACAATCAAAATCAGAAACTAAAGGTTCT
AAAGATACAGTAAAAATTGAAAATAACTATAAAATGCGTGGCGAGAAAAAG
ATGGTAGTGACGCTAAAAAGTTAAAGAAACTGTTGAAGTACCAAAAAATCC
TAAAAATGCAGTTGTGTTAGACTATGGCGCATTAGATGTAATGAAAGAAATGG
GCTTATCAGATAAAGTAAAAGCATTACCTAAAGGGGAAGGCGGTAAGTCATT
ACCGAATTTCTTAGAATCATTTAAAGATGATAAATATACAAACGTTGGTAATT
TAAAAGAAGTGAATTTGATAAAATTGCTGCGACGAAACCCGAAGTAATCTTT
ATCTCTGGACGTACAGCTAATCAAAAGAATTTAGATGAATTCAAAAAAGCTGC
ACCTAAAGCGAAAATTGTTTATGTTGGTGCAGATGAAAGAACTTAATTGGTT
CAATGAAACAAAACACTGAAAATATCGGAAAAATTTACGATAAAGAAGATAA
AGCTAAAGAATTAAATAAAGATTTAGATAACAAAATTGCTTCAATGAAAGAT
AAAACGAAAAACTTCAATAAAACTGTTATGTATTTACTAGTTAACGAAGGTGA
ATTATCAACATTTGGACCTAAAGGTCGTTTTGGTGGATTAGTTTACGATACATT
AGGATTCAATGCAGTTGATAAAAAGTAAGTAATAGCAATCATGGACAAAAT
GTTTCTAACGAATATGTTAATAAAGAAATCCAGATGTTATTTAGCGATGGA
TAGAGGTCAAGCGATAAGTGGTAAATCAACTGCGAAACAAGCATTAAATAAT
CCTGTATTAAAAAATGTTAAAGCAATTAAAGAAGACAAAGTATATAATTTAGA
TCCTAAATTATGGTACTTTGCAGCTGGATCAACTACAACTACAATTAAACAAA
TTGAGGAACTTGATAAAGTTGTAAAATAA (SEQ ID NO:567)

Figure 187

ATGAAGAAAACAGTCTTATATTTAGTATTAGCAGTAATGTTTTTATTAGCGGC
ATGCGGTAACAATTCTGATAAAGAACAATCAAAATCAGAAACTAAAGGTTCT
AAAGATACAGTAAAAATTGAAAATAACTATAAAATGCGTGGCGAGAAAAAAG
ATGGTAGTGACGCTAAAAAAGTTAAAGAAACTGTTGAAGTACCAAAAAATCC
TAAAAATGCAGTTGTGTTAGACTATGGCGCATTAGATGTAATGAAAGAAATGG
GCTTATCAGATAAAGTAAAAGCATTACCTAAAGGGGAAGGCGGTAAGTCATT
ACCGAATTTCTTAGAATCATTTAAAGATGATAAATATACAAACGTTGGTAATT
TAAAAGAAGTGAATTTTGATAAAATTGCTGCGACGAAACCCGAAGTAATCTTT
ATCTCTGGACGTACAGCTAATCAAAGAATTTAGATGAATTCAAAAAGCTGC
ACCTAAAGCGAAAATTGTTTATGTTGGTGCAGATGAAAGAACTTAATTGGTT
CAATGAAACAAAACACTGAAAATATCGGTAAAATTTACGATAAAGAAGATAA
AGCTAAAGAATTAAATAAAGATTTAGATAACAAAATTGCTTCAATGAAAGAT
AAAACGAAAAACTTCAATAAAACTGTTATGTATTTACTAGTTAACGAAGGTGA
ATTATCAACATTTGGACCTAAAGGTCGTTTTGGTGGATTAGTTTACGATACATT
AGGATTCAATGCAGTTGATAAAAAGTAAGTAATAGCAATCATGGACAAAAT
GTTTCTAACGAATATGTTAATAAAGAAAATCCAGATGTTATTTAGCGATGGA
TAGAGGTCAAGCGATAAGTGGTAAATCAACTGCGAAACAAGCATTAAATAAT
CCTGTATTAAAAAATGTTAAAGCAATTAAAGAAGACAAAGTATATAATTTAGA
TCCTAAATTATGGTACTTTGCAGCTGGATCAACTACAACTACAATTAAACAAA
TTGAGGAACTTGATAAAGTTGTAAAATAA
(SEQ ID NO:568)

Figure 188

ATGAAGAAAACAGTCTTATATTTAGTATTAGCAGTAATGTTTTTATTAGCGGC
ATGCGGTAACAATTCTGATAAAGAACAATCAAAATCAGAAACTAAAGGTTCT
AAAGATACAGTAAAAATTGAAAATAACTATAAATGCGTGGCGAGAAAAAG
ATGGTAGTGACGCTAAAAAAGTTAAAGAAACTGTTGAAGTACCAAAAAATCC
TAAAAATGCAGTTGTGTTAGACTATGGCGCATTAGATGTAATGAAAGAAATGG
GCTTATCAGATAAAGTAAAAGCATTACCTAAAGGGGAAGGCGGTAAGTCATT
ACCGAATTTCTTAGAATCATTTAAAGATGATAAATATACAAACGTTGGTAATT
TAAAAGAAGTGAATTTTGATAAATTGCTGCGACGAAACCCGAAGTAATCTTT
ATCTCTGGACGTACAGCTAATCAAAAGAATTTAGATGAATTCAAAAAAGCTGC
ACCTAAAGCGAAAATTGTTTATGTTGGTGCAGATGAAAAGAACTTAATTGGTT
CAATGAAACAAAACACTGAAAATATCGGAAAAATTTACGATAAAGAAGATAA
AGCTAAAGAATTAAATAAAGATTTAGATAACAAAATTGCTTCAATGAAAGAT
AAAACGAAAAACTTCAATAAAACTGTTATGTATTTACTAGTTAACGAAGGTGA
ATTATCAACATTTGGACCTAAAGGTCGTTTTGGTGGATTAGTTTACGATACATT
AGGATTCAATGCAGTTGATAAAAAGTAAGTAATAGCAATCATGGACAAAAT
GTTTCTAACGAATATGTTAATAAAGAAATCCAGATGTTATTTAGCGATGGA
TAGAGGTCAAGCGATAAGTGGTAAATCAACTGCGAAACAAGCATTAAATAAT
CCTGTATTAAAAAATGTTAAAGCAATTAAAGAAGACAAAGTATATAATTTAGA
TCCTAAATTATGGTACTTTGCAGCTGGATCAACTACAACTACAATTAAACAAA
TTGAGGAACTTGATAAAGTTGTAAATAA (SEQ ID NO:569)

Figure 189

ATGAAGAAAACAGTCTTATATTTAGTATTAGCAGTAATGTTTTTATTAGCGGC
ATGCGGTAACAATTCTGATAAAGAACAATCAAAATCAGAAACTAAAGGTTCT
AAAGATACAGTAAAAATTGAAAATAACTATAAAATGCGTGGCGAGAAAAAAG
ATGGTAGTGACGCTAAAAAAGTTAAAGAAACTGTTGAAGTACCAAAAAATCC
TAAAAATGCAGTTGTGTTAGACTATGGCGCATTAGATGTAATGAAAGAAATGG
GCTTATCAGATAAAGTAAAAGCATTACCTAAAGGGGAAGGCGGTAAGTCATT
ACCGAATTTCTTAGAATCATTTAAAGATGATAAATATACAAACGTTGGTAATT
TAAAAGAAGTGAATTTTGATAAAATTGCTGCGACGAAACCCGAAGTAATCTTT
ATCTCTGGACGTACAGCTAATCAAAAGAATTTAGATGAATTCAAAAAAGCTGC
ACCTAAAGCGAAAATTGTTTATGTTGGTGCAGATGAAAGAACTTAATTGGTT
CAATGAAACAAAACACTGAAAATATCGGAAAAATTTACGATAAAGAAGATAA
AGCTAAAGAATTAAATAAAGATTTAGATAACAAAATTGCTTCAATGAAAGAT
AAAACGAAAAACTTCAATAAAACTGTTATGTATTTACTAGTTAACGAAGGTGA
ATTATCAACATTTGGACCTAAAGGTCGTTTTGGTGGATTAGTTTACGATACATT
AGGATTCAATGCAGTTGATAAAAAGTAAGTAATAGCAATCATGGACAAAAT
GTTTCTAACGAATATGTTAATAAAGAAAATCCAGATGTTATTTTAGCGATGGA
TAGAGGTCAAGCGATAAGTGGTAAATCAACTGCGAAACAAGCATTAAATAAT
CCTGTATTAAAAAATGTTAAAGCAATTAAAGAAGACAAAGTATATAATTTAGA
TCCTAAATTATGGTACTTTGCAGCTGGATCAACTACAACTACAATTAAACAAA
TTGAGGAACTTGATAAAGTTGTAAAATAA
(SEQ ID NO:570)

Figure 190

ATGAAGAAAACAGTCTTATATTTAGTATTAGCAGTAATGTTTTTATTAGCGGC
ATGCGGTAACAATTCTGATAAAGAACAATCAAAATCAGAACTAAAGGTTCT
AAAGATACAGTAAAAATTGAAAATAACTATAAAATGCGTGGCGAGAAAAAAG
ATGGTAGTGACGCTAAAAAAGTTAAAGAAACTGTTGAAGTACCAAAAAATCC
TAAAAATGCAGTTGTGTTAGACTATGGCGCATTAGATGTAATGAAAGAAATGG
GCTTATCAGATAAAGTAAAAGCATTACCTAAAGGGGAAGGCGGTAAGTCATT
ACCGAATTTCTTAGAATCATTTAAAGATGATAAATATACAAACGTTGGTAATT
TAAAAGAAGTGAATTTTGATAAAATTGCTGCGACGAAACCCGAAGTAATCTTT
ATCTCTGGACGTACAGCTAATCAAAGAATTTAGATGAATTCAAAAAAGCTGC
ACCTAAAGCGAAAATTGTTTATGTTGGTGCAGATGAAAGAACTTAATTGGTT
CAATGAAACAAAACACTGAAAATATCGGAAAAATTTACGATAAAGAAGATAA
AGCTAAAGAATTAAATAAAGATTTAGATAACAAAATTGCTTCAATGAAAGAT
AAAACGAAAAACTTCAATAAACTGTTATGTATTTACTAGTTAACGAAGGTGA
ATTATCAACATTTGGACCTAAAGGTCGTTTTGGTGGATTAGTTTACGATACATT
AGGATTCAATGCAGTTGATAAAAAGTAAGTAATAGCAATCATGGACAAAAT
GTTTCTAACGAATATGTTAATAAAGAAATCCAGATGTTATTTTAGCGATGGA
TAGAGGTCAAGCGATAAGTGGTAAATCAACTGCGAAACAAGCATTAAATAAT
CCTGTATTAAAAAATGTTAAAGCAATTAAAGAAGACAAAGTATATAATTTAGA
TCCTAAATTATGGTACTTTGCAGCTGGATCAACTACAACTACAATTAAACAAA
TTGAGGAACTTGATAAAGTTGTAAAATAA
(SEQ ID NO:571)

Figure 191

ATGAAGAAAACAGTCTTATATTTAGTATTAGCAGTAATGTTTTTATTAGCGGC
ATGCGGTAACAATTCTGATAAAGAACAATCAAAATCAGAAACTAAAGGTTCT
AAAGATACAGTAAAAATTGAAAATAACTATAAAATGCGTGGCGAGAAAAAAG
ATGGTAGTGACGCTAAAAAAGTTAAAGAAACTGTTGAAGTACCAAAAAATCC
TAAAAATGCAGTTGTGTTAGACTATGGCGCATTAGATGTAATGAAAGAAATGG
GCTTATCAGATAAAGTAAAAGCATTACCTAAAGGGGAAGGCGGTAAGTCATT
ACCGAATTTCTTAGAATCATTTAAAGATGATAAATATACAAACGTTGGTAATT
TAAAAGAAGTGAATTTTGATAAAATTGCTGCGACGAAACCCGAAGTAATCTTT
ATCTCTGGACGTACAGCTAATCAAAGAATTTAGATGAATTCAAAAAGCTGC
ACCTAAAGCGAAAATTGTTTATGTTGGTGCAGATGAAAGAACTTAATTGGTT
CAATGAAACAAAACACTGAAAATATCGGTAAAATTTACGATAAAGAAGATAA
AGCTAAAGAATTAAATAAAGATTTAGATAACAAAATTGCTTCAATGAAAGAT
AAAACGAAAAACTTCAATAAAACTGTTATGTATTTACTAGTTAACGAAGGTGA
ATTATCAACATTTGGACCTAAAGGTCGTTTTGGTGGATTAGTTTACGATACATT
AGGATTCAATGCAGTTGATAAAAAAGTAAGTAATAGCAATCATGGACAAAAT
GTTTCTAACGAATATGTTAATAAAGAAATCCAGATGTTATTTAGCGATGGA
TAGAGGTCAAGCGATAAGTGGTAAATCAACTGCGAAACAAGCATTAAATAAT
CCTGTATTAAAAAATGTTAAAGCAATTAAAGAAGACAAAGTATATAATTTAGA
TCCTAAATTATGGTACTTTGCAGCTGGATCAACTACAACTACAATTAAACAAA
TTGAGGAACTTGATAAAGTTGTAAAATAA
(SEQ ID NO:572)

Figure 192

ATGAAAAAACTATTATTACCATTAATAATTATGTTATTAGTGTTAGCTGCGTGT
GGGAACCAAGGTGAAAAAATAACAAAGCTGAAACTAAATCTTATAAAATGG
ACGATGGCAAACGGTAGATATTCCGAAAGACCCTAAACGCATTGCAGTAGT
TGCGCCAACATATGCTGGTGGACTTAAAAAATTAGGTGCAAACATTGTAGCTG
TAAATCAACAAGTCGATCAAAGCAAAGTATTAAAAGATAAATTTAAAGGTGT
TACAAAAATTGGTGATGGCGATGTAGAAAAGGTTGCTAAAGAAAGCCAGAT
TTAATTATTGTATACTCTACTGACAAGACATTAAAAAATATCAAAAGTAGC
ACCAACAGTAGTTGTTGACTATAATAAGCATAAATATTTAGAACAACAAGAA
ATGTTAGGGAAAATTGTTGGTAAAGAAGATAAAGTAAAAGCTTGGAAGAAAG
ATTGGGAAGAAACAACTGCTAAAGACGGTAAAGAAATTAAAAAAGCAATTGG
ACAAGATGCAACAGTGTCGTTGTTTGATGAATTTGATAAAAAATTATACACTT
ACGGCGATAACTGGGGTCGTGGTGGAGAAGTACTATATCAAGCATTTGGTTTA
AAAATGCAACCAGAACAACAAAGTTAACTGCAAAAGCAGGTTGGGCTGAAG
TGAAACAAGAAGAAATTGAAAATATGCTGGTGATTACATTGTGAGTACAAG
TGAAGGTAAACCTACACCAGGATATGAATCAACAAACATGTGGAAGAATTTG
AAAGCTACTAAAGAAGGACATATTGTTAAGTTGATGCTGGTACATACTGGTA
CAACGATCCTTATACATTAGATTTCATGCGTAAAGATTTAAAAGAAAAATTAA
TTAAAGCTGCAAAATAA
(SEQ ID NO:573)

Figure 193

ATGAAAAAACTATTATTACCATTAATAATTATGTTATTAGTGTTAGCTGCGTGT
GGGAACCAAGGTGAAAAAATAACAAAGCTGAAACTAAATCTTATAAAATGG
ACGATGGCAAAACGGTAGATATTCCGAAAGACCCTAAACGCATTGCAGTAGT
TGCGCCAACATATGCTGGTGGACTTAAAAAATTAGGTGCAAACATTGTAGCTG
TAAATCAACAAGTCGATCAAAGCAAAGTATTAAAAGATAAATTTAAAGGTGT
TACAAAATTGGTGATGGCGATGTAGAAAAGTTGCTAAAGAAAGCCAGAT
TTAATTATTGTATACTCTACTGACAAAGATATTAAAAAATATCAAAAGTAGC
ACCAACAGTAGTTGTTGACTATAATAAGCATAAATATTTAGAACAACAAGAA
ATGTTAGGGAAAATTGTTGGTAAAGAAGATAAAGTAAAAGCTTGGAAGAAAG
ATTGGAAGAAACAACTGCTAAAGACGGTAAAGAAATTAAAAAAGCAATTGG
ACAAGATGCAACAGTGTCATTGTTTGATGAATTTGATAAAAAATTATACACTT
ACGGCGATAACTGGGGTCGTGGTGGAGAAGTATTATATCAAGCATTTGGTTTG
AAAATGCAACCAGAACAACAAAAGTTAACTGCAAAAGCAGGTTGGGCTGAAG
TGAAACAAGAAGAAATTGAAAAATATGCTGGTGATTACATTGTGAGTACAAG
TGAAGGTAAACCTACACCAGGATATGAATCAACAAACATGTGGAAGAATTTG
AAAGCTACTAAAGAAGGACATATTGTTAAAGTTGATGCTGGTACATACTGGTA
CAACGATCCTTATACATTAGATTTCATGCGTAAAGATTTAAAAGAAAAATTAA
TTAAAGCTGCAAAATAA (SEQ ID NO:574)

Figure 194

ATGAAAAAACTATTATTACCATTAATAATTATGTTATTAGTGTTAGCTGCGTGT
GGGAACCAAGGTGAAAAAATAACAAAGCTGAAACTAAATCTTATAAAATGG
ACGATGGCAAAACGGTAGATATTCCGAAAGACCCTAAACGCATTGCAGTAGT
TGCGCCAACATATGCTGGTGGACTTAAAAAATTAGGTGCAAACATTGTAGCTG
TAAATCAACAAGTTGATCAAAGCAAAGTGTTAAAAGATAAATTTAAAGGTGTT
ACTAAAATTGGTGATGGTGATATAGAAAAGTTGCTAAAGAAAAGCCAGATT
TAATTATTGTATACTCTACTGACAAAGACATTAAAAAGTATCAAAAAGTAGCA
CCAACAGTAGTTGTTGACTATAATAAGCATAAATACTTAGAACAACAAGAAAT
GTTAGGGAAAATTGTTGGTAAAGAAGATAAAGTAAAAGCTTGGAAGAAAGAT
TGGGAAGAAACAACTGCTAAAGACGGTAAAGAAATTAAAAAAGCAATTGGAC
AAGATGCAACAGTGTCATTGTTTGATGAATTTGATAAAAAATTATACACTTAC
GGCGATAACTGGGGTCGTGGTGGAGAAGTATTATATCAAGCATTTGGTTTAAA
AATGCAACCAGAACAACAAAAGTTAACTGCAAAAGCAGGTTGGGCTGAAGTG
AAACAAGAAGAAATTGAAAAATATGCTGGTGATTACATTGTGAGTACAAGTG
AAGGTAAACCTACACCAGGATACGAATCAACAAACATGTGGAAGAATTTGAA
AGCTACTAAAGAAGGACATATTGTTAAAGTTGATGCTGGTACATACTGGTACA
ACGATCCTTATACATTAGATTTCATGCGTAAAGATTTAAAAGAAAAATTAATT
AAAGCTGCAAAATAA
(SEQ ID NO:575)

Figure 195

ATGAAAAAACTATTATTACCATTAATAATTATGTTATTAGTGTTAGCTGCGTGT
GGGAACCAAGGTGAAAAAAATAACAAAGCTGAAACTAAATCTTATAAAATGG
ACGATGGCAAAACGGTAGATATTCCGAAAGACCCTAAACGCATTGCAGTAGT
TGCGCCAACATATGCTGGTGGACTTAAAAAATTAGGTGCAAACATTGTAGCTG
TAAATCAACAAGTCGATCAAAGCAAAGTATTAAAAGATAAATTTAAAGGTGT
TACAAAAATTGGTGATGGCGATGTAGAAAAGTTGCTAAAGAAAAGCCAGAT
TTAATTATTGTATACTCTACTGACAAAGATATTAAAAAATATCAAAAAGTAGC
ACCAACAGTAGTTGTTGACTATAATAAGCATAAATATTTAGAACAACAAGAA
ATGTTAGGGAAAATTGTTGGTAAAGAAGATAAAGTAAAAGCTTGGAAGAAAG
ATTGGGAAGAAACAACTGCTAAAGACGGTAAAGAAATTAAAAAAGCAATTGG
ACAAGATGCAACAGTGTCATTGTTTGATGAATTTGATAAAAAATTATACACTT
ACGGCGATAACTGGGGTCGTGGTGGAGAAGTATTATATCAAGCATTTGGTTTA
AAAATGCAACCAGAACAACAAAAGTTAACTGCAAAAGCAGGTTGGGCTGAAG
TGAAACAAGAAGAAATTGAAAAATATGCTGGTGATTACATTGTGAGTACAAG
TGAAGGTAAACCTACACCAGGATATGAATCAACAAACATGTGGAAGAATTTG
AAAGCTACTAAAGAAGGACATATTGTTAAAGTTGATGCTGGTACATACTGGTA
CAACGATCCTTATACATTAGATTTCATGCGTAAAGATTTAAAAGAAAAATTAA
TTAAAGCTGCAAAATAA (SEQ ID NO:576)

Figure 196

ATGAAAAAACTATTATTACCATTAATAATTATGTTATTAGTGTTAGCTGCGTGT
GGGAACCAAGGTGAAAAAATAACAAAGCTGAAACTAAATCTTATAAAATGG
ACGATGGCAAAACGGTAGATATTCCGAAAGACCCTAAACGCATTGCAGTAGT
TGCGCCAACATATGCTGGTGGACTTAAAAAATTAGGTGCAAACATTGTAGCTG
TAAATCAACAAGTCGATCAAAGCAAAGTATTAAAAGATAAATTTAAAGGTGT
TACAAAAATTGGTGATGGCGATGTAGAAAAGTTGCTAAAGAAAAGCCAGAT
TTAATTATTGTATACTCTACTGACAAAGATATTAAAAAATATCAAAAGTAGC
ACCAACAGTAGTTGTTGACTATAATAAGCATAAATATTTAGAACAACAAGAA
ATGTTAGGGAAAATTGTTGGTAAAGAAGATAAAGTAAAGCTTGGAAGAAAG
ATTGGGAAGAAACAACTGCTAAAGACGGTAAAGAAATTAAAAAAGCAATTGG
ACAAGATGCAACAGTGTCATTGTTTGATGAATTTGATAAAAAATTATACACTT
ACGGCGATAACTGGGGTCGTGGTGGAGAAGTATTATATCAAGCATTGGTTTG
AAAATGCAACCAGAACAACAAAAGTTAACTGCAAAAGCAGGTTGGGCTGAAG
TGAAACAAGAAGAAATTGAAAAATATGCTGGTGATTACATTGTGAGTACAAG
TGAAGGTAAACCTACACCAGGATACGAATCAACAAACATGTGGAAGAATTTG
AAAGCTACTAAAGAAGGACATATTGTTAAAGTTGATGCTGGTACATACTGGTA
CAACGATCCTTATACATTAGATTTCATGCGTAAAGATTTAAAAGAAAAATTAA
TTAAAGCTGCAAAATAA
(SEQ ID NO:577)

Figure 197

ATGAAAAAACTATTATTACCATTAATAATTATGTTATTAGTGTTAGCTGCGTGT
GGGAACCAAGGTGAAAAAAATAACAAAGCTGAAACTAAATCTTATAAAATGG
ACGATGGCAAAACGGTAGATATTCCGAAAGACCCTAAACGCATTGCAGTAGT
TGCGCCAACATATGCTGGTGGACTTAAAAAATTAGGTGCAAACATTGTAGCTG
TAAATCAACAAGTCGATCAAAGCAAGTATTAAAAGATAAATTTAAAGGTGT
TACAAAAATTGGTGATGGCGATGTAGAAAAGTTGCTAAAGAAAGCCAGAT
TTAATTATTGTATACTCTACTGACAAGATATTAAAAAATATCAAAAGTAGC
ACCAACAGTAGTTGTTGACTATAATAAGCATAAATATTTAGAACAACAAGAA
ATGTTAGGGAAAATTGTTGGTAAAGAAGATAAAGTAAAAGCCTGGAAGAAAG
ATTGGGAAGAAACAACTGCTAAAGACGGTAAAGAAATTAAAAAAGCAATTGG
ACAAGATGCAACAGTGTCATTGTTTGATGAATTTGATAAAAATTATACACTT
ACGGCGATAACTGGGGTCGTGGTGGAGAAGTATTATATCAAGCATTTGGTTTG
AAAATGCAACCAGAACAACAAAAGTTAACTGCAAAAGCAGGTTGGGCTGAAG
TGAAACAAGAAGAAATTGAAAAATATGCTGGTGATTACATTGTGAGTACAAG
TGAAGGTAAACCTACACCAGGATATGAATCAACAAACATGTGGAAGAATTTG
AAAGCTACTAAAGAAGGACATATTGTTAAAGTTGATGCTGGTACATACTGGTA
CAACGATCCTTATACATTAGATTTCATGCGTAAAGATTTAAAAGAAAAATTAA
TTAAAGCTGCAAAATAA
(SEQ ID NO:578)

Figure 198

ATGAAAAAACTATTATTACCATTAATAATTATGTTATTAGTGTTAGCTGCGTGT
GGGAACCAAGGTGAAAAAAATAACAAAGCTGAAACTAAATCTTATAAAATGG
ACGATGGCAAAACGGTAGATATTCCGAAAGACCCTAAACGCATTGCAGTAGT
TGCGCCAACATATGCTGGTGGACTTAAAAAATTAGGTGCAAACATTGTAGCTG
TAAATCAACAAGTCGATCAAAGCAAGTATTAAAGATAAATTTAAAGGTGT
TACAAAAATTGGTGATGGCGATGTAGAAAAAGTTGCTAAAGAAAGCCAGAT
TTAATTATTGTATACTCTACTGACAAGATATTAAAAAATATCAAAAAGTAGC
ACCAACAGTAGTTGTTGACTATAATAAGCATAAATATTTAGAACAACAAGAA
ATGTTAGGGAAAATTGTTGGTAAAGAAGATAAAGTAAAAGCTTGGAAGAAAG
ATTGGGAAGAAACAACTGCTAAAGACGGTAAAGAAATTAAAAAAGCAATTGG
ACAAGATGCAACAGTGTCATTGTTTGATGAATTTGATAAAAAATTATACACTT
ACGGCGATAACTGGGGTCGTGGTGGAGAAGTATTATATCAAGCATTTGGTTTG
AAAATGCAACCAGAACAACAAAGTTAACTGCAAAAGCAGGTTGGGCTGAAG
TGAAACAAGAAGAAATTGAAAAATATGCTGGTGATTACATTGTGAGTACAAG
TGAAGGTAAACCTACACCAGGATACGAATCAACAAACATGTGGAAGAATTTG
AAAGCTACTAAAGAAGGACATATTGTTAAAGTTGATGCTGGTACATACTGGTA
CAACGATCCTTATACATTAGATTTCATGCGTAAAGATTTAAAAGAAAAATTAA
TTAAAGCTGCAAAATAA
(SEQ ID NO:579)

Figure 199

ATGAAAAAACTATTATTACCATTAATAATTATGTTATTAGTGTTAGCTGCGTGT
GGGAACCAAGGTGAAAAAAATAACAAAGCTGAAACTAAATCTTATAAAATGG
ACGATGGCAAAACGGTAGATATTCCGAAAGACCCTAAACGCATTGCAGTAGT
TGCGCCAACATATGCTGGTGGACTTAAAAAATTAGGTGCAAACATTGTAGCTG
TAAATCAACAAGTCGATCAAAGCAAAGTATTAAAGATAAATTTAAAGGTGT
TACAAAAATTGGTGATGGCGATGTAGAAAAGTTGCTAAAGAAAGCCAGAT
TTAATTATTGTATACTCTACTGACAAGATATTAAAAAATATCAAAAAGTAGC
ACCAACAGTAGTTGTTGACTATAATAAGCATAAATATTTAGAACAACAAGAA
ATGTTAGGGAAAATTGTTGGTAAAGAAGATAAAGTAAAGCTTGGAAGAAAG
ATTGGGAAGAAACAACTGCTAAAGACGGTAAAGAAATTAAAAAAGCAATTGG
ACAAGATGCAACAGTGTCATTGTTTGATGAATTTGATAAAAAATTATACACTT
ACGGCGATAACTGGGGTCGTGGTGGAGAAGTATTATATCAAGCATTTGGTTTG
AAAATGCAACCAGAACAACAAAGTTAACTGCAAAAGCAGGTTGGGCTGAAG
TGAAACAAGAAGAAATTGAAAAATATGCTGGTGATTACATTGTGAGTACAAG
TGAAGGTAAACCTACACCAGGATACGAATCAACAAACATGTGGAAGAATTTG
AAAGCTACTAAAGAAGGACATATTGTTAAAGTTGATGCTGGTACATACTGGTA
CAACGATCCTTATACATTAGATTTCATGCGTAAAGATTTAAAAGAAAAATTAA
TTAAAGCTGCAAATAA
(SEQ ID NO:580)

Figure 200

ATGAAAAAACTATTATTACCATTAATAATTATGTTATTAGTGTTAGCTGCGTGT
GGGAACCAAGGTGAAAAAATAACAAAGCTGAAACTAAATCTTATAAAATGG
ACGATGGCAAAACGGTAGATATTCCGAAAGACCCTAAACGCATTGCAGTAGT
TGCGCCAACATATGCTGGTGGACTTAAAAAATTAGGTGCAAACATTGTAGCTG
TAAATCAACAAGTCGATCAAAGCAAAGTATTAAAAGATAAATTTAAAGGTGT
TACAAAAATTGGTGATGGCGATGTAGAAAAGTTGCTAAAGAAAGCCAGAT
TTAATTATTGTATACTCTACTGACAAAGATATTAAAAAATATCAAAAGTAGC
ACCAACAGTAGTTGTTGACTATAATAAGCATAAATATTTAGAACAACAAGAA
ATGTTAGGGAAAATTGTTGGTAAAGAAGATAAAGTAAAAGCTTGGAAGAAAG
ATTGGGAAGAAACAACTGCTAAAGACGGTAAAGAATTAAAAAAGCAATTGG
ACAAGATGCAACAGTGTCATTGTTTGATGAATTTGATAAAAATTATACACTT
ACGGCGATAACTGGGGTCGTGGTGGAGAAGTATTATATCAAGCATTTGGTTTG
AAAATGCAACCAGAACAACAAAGTTAACTGCAAAAGCAGGTTGGGCTGAAG
TGAAACAAGAAGAAATTGAAAAATATGCTGGTGATTACATTGTGAGTACAAG
TGAAGGTAAACCTACACCAGGATACGAATCAACAAACATGTGGAAGAATTTG
AAAGCTACTAAAGAAGGACATATTGTTAAAGTTGATGCTGGTACATACTGGTA
CAACGATCCTTATACATTAGATTTCATGCGTAAAGATTTAAAAGAAAAATTAA
TTAAAGCTGCAAAATAA (SEQ ID NO:581)

Figure 201

ATGAAAAAACTATTATTACCATTAATAATTATGTTATTAGTGTTAGCTGCGTGT
GGGAACCAAGGTGAAAAAATAACAAAGCTGAAACTAAATCTTATAAAATGG
ACGATGGCAAAACGGTAGATATTCCGAAAGACCCTAAACGCATTGCAGTAGT
TGCGCCAACATATGCTGGTGGACTTAAAAAATTAGGTGCAAACATTGTAGCTG
TAAATCAACAAGTCGATCAAAGCAAAGTATTAAAAGATAAATTTAAAGGTGT
TACAAAAATTGGTGATGGCGATGTAGAAAAGTTGCTAAAGAAAGCCAGAT
TTAATTATTGTATACTCTACTGACAAAGATATTAAAAAATATCAAAAGTAGC
ACCAACAGTAGTTGTTGACTATAATAAGCATAAATATTTAGAACAACAAGAA
ATGTTAGGGAAAATTGTTGGTAAAGAAGATAAAGTAAAGCTTGGAAGAAAG
ATTGGGAAGAAACAACTGCTAAAGACGGTAAAGAAATTAAAAAAGCAATTGG
ACAAGATGCAACAGTGTCATTGTTTGATGAATTTGATAAAAAATTATACACTT
ACGGCGATAACTGGGGTCGTGGTGGAGAAGTATTATATCAAGCATTTGGTTTA
AAAATGCAACCAGAACAACAAAAGTTAACTGCAAAAGCAGGTTGGGCTGAAG
TGAAACAAGAAGAAATTGAAAAATATGCTGGTGATTACATTGTGAGTACAAG
TGAAGGTAAACCTACACCAGGATATGAATCAACAAACATGTGGAAGAATTTG
AAAGCTACTAAAGAAGGACATATTGTTAAAGTTGATGCTGGTACATACTGGTA
CAACGATCCTTATACATTAGATTTCATGCGTAAAGATTTAAAAGAAAAATTAA
TTAAAGCTGCAAAATAA (SEQ ID NO:582)

POLYPEPTIDES AND IMMUNIZING COMPOSITIONS CONTAINING GRAM POSITIVE POLYPEPTIDES AND METHODS OF USE

CROSS-REFERENCE TO RELATED APPLICATION

This application is the § 371 U.S. National Stage of International Application No. PCT/US2010/028326, filed 23 Mar. 2010, which claims priority to U.S. Provisional Patent Application Ser. No. 61/210,772, filed Mar. 23, 2009, which are incorporated by reference herein in their entireties.

BACKGROUND

Gram-positive bacteria are a remarkably diverse group of organisms that cause a variety of diseases in both humans and animals. Some of the pathogens recognized as important in human and/or animal health include bacteria belonging to the families of Corynebacteriaceae, Enterococcacae, Micrococcaceae, Mycobacteriaceae, Nocardiaceae, and Peptococcaceae, which include such bacterial species as *Actinomyces* spp., *Bifidobacterium* spp., *Corynebacterium* spp., *Enterococcus* spp., *Erysipelothrix* spp., *Eubacterium* spp., *Kytococcus* spp., *Lactobacillus* spp., *Micrococcus* spp., *Mobiluncus* spp., *Mycobacteria* spp., *Peptostreptococcus* spp., *Propionibacterium* spp., and *Staphylococcus* spp. These pathogens cause a multitude of clinical manifestations in many different animal species. The treatment for such infections has historically been antibiotics that attack the common structures and functions of gram-positive organisms. However, many of the more ubiquitous gram-positive organisms have developed resistance to several classes of antibiotics, making treatment of infections difficult. The widespread use of antibiotics in the treatment of bacterial diseases in both humans and food production animals is likely a major contributing factor in the proliferation of antibiotic-resistant strains of many species of gram-positive organisms. Therefore, there is a great need to find different treatments that prevent or eliminate infections by gram-positive organisms in animals as well as humans.

Staphylococcal Infections in Agricultural Animals

In the agricultural industry a number of important diseases are caused by gram-positive organisms. Examples of clinical conditions caused by gram positive bacterial infections include, mastitis, septicemia, pneumonia, osteomyelitis, meningoencephalitis, lymphangitis, dermatitis, genital tract infections, metritis, perinatal disease, pituitary abscesses, arthritis, bursitis, orchitis, cystitis and pyelonephritis, caseous lymphadenitis, tuberculosis, ulcerative lymphangitis, erysipelas, laminitis, tyzzer's disease, tetanus, botulism, enteritis, malignant edema, braxy, bacillary hemoglobinuria, enterotoxemia. *Staphylococcus* spp., in particular, are capable of infecting many different species of agricultural animals and can cause enormous economic losses. For example, the United States dairy industry is estimated to lose approximately $185 per cow annually due to mastitis, a disease often caused by *Staphylococcus aureus*. Since there are 9.5 million head of milking cows in the U.S., the annual cost of mastitis is approximately $1.8 billion. This is approximately 10% of the total value of farm milk sales, and about two-thirds of this loss is due to reduced milk production in sub-clinically infected cows. Other losses are due to discarded abnormal milk and milk withheld from cows treated with antibiotic, costs of early replacement of affected cows, reduced sale value of culled cows, costs of drugs and veterinary services, and increased labor costs. In addition to its prevalence within the bovine dairy industry, mastitis caused by gram-positive cocci is also common among goats and sheep. Additional animal diseases caused by *S. aureus* include botryomycosis in horses, purulent synovitis and osteomyelitis in poultry, snuffles in rabbits, abortions in swine, and tick pyemia in lambs. Other species of staphylococci are major skin pathogens of canine (*S. intermedius*) and swine (*S. hycius*). In poultry species, staphylococcal pathogens cause endorcarditis and septicemia.

Staphylococcal Infections in Humans

*Staphylococcus* spp. are also human pathogens causing a wide variety of infections. The species *Staphylococcus aureus*, a common colonizer of human mucosa and skin, is an opportunistic pathogen that can cause diverse human infections. For example, *S. aureus* is the causative agent of several skin infections, including impetigo, furunculosis, cellulitus, and scalded skin syndrome, as well as potentially fatal post-surgical wound infections. In addition, the exposure of immunocompromised individuals to *S. aureus* in hospital settings has resulted in organ infections such as pneumonia, urinary tract infections, osteomyelitis, arthritis, bacteremia, and endocarditis. *S. aureus* is also the causative agent of toxinoses, most notably toxic shock syndrome and food poisoning. Food poisoning caused by the staphylococcal enterotoxin B is the most common cause of food-borne illness, surpassing even salmonellosis, campylobacteriosis and listeriosis. Other species of staphylococci also cause human disease; *S. epidermidis*, *S. haemolyticus* and *S. hominis* commonly infect implanted medical devices and *S. saprophyticus* is associated with urinary tract infections in women.

Virulence Mechanisms of Staphylococci

Staphylococci infect a variety of host tissues and evade the immune system through the production of several types of secreted proteins, surface expressed virulence factors and metabolic systems designed for survival amidst the limited resources and active defenses associated with the host environment. Colonization is the necessary first step in establishing infection; numerous factors including capsule, lipoteichoic acid, and teichoic acid are common structural components contributing to colonization. In addition, surface proteins such as staphylococcal fibronectin-binding protein and bone-sialoprotein binding proteins specifically bind host tissue components. Toxins are commonly produced among staphylococcal pathogens and are highly damaging; several human diseases, including food poisoning, toxic shock syndrome and exfoliative skin conditions, are the direct result of extracellular secreted toxin proteins. A single isolate may encode genes for 20-30 different secreted toxins. Some of the secreted protein products are superantigens that can bind nonspecifically to the MHC class II molecule of an antigen-presenting cell and, simultaneously, to the T-cell receptor of a T cell. The binding induces T cell signaling and leads to the release of high levels of proinflammatory factors, ultimately inducing host damage due to the overwhelming immune response. Another class of virulence factors expressed on the surface disguise the bacteria from the host immune system. For example, the *S. aureus* surface-expressed Protein A inhibits opsonization and phagocytosis by binding of the Fc component of host antibody. Numerous proteases, hemolysins (alpha, beta, gamma and delta), nucleases, lipases, hyaluronidase, and collagenase also aid bacteria in extracting nutrients from surrounding cells and protecting them against host defenses.

Antibiotic Resistance Among Staphylococci

The CDC estimates that each year nearly 2 million people in the United States acquire a nosocomial infection, resulting in 90,000 deaths annually. Of these fatal infections, 70% are caused by antibiotic-resistant bacteria. The increase in antibiotic-resistance among microbial species is particularly pronounced in skin and mucosal colonizers such as *S. aureus*. For example, the vast majority of *S. aureus* isolated from hospital settings are resistant to penicillin, and 50% are also resistant to the semisynthetic penicillins, such as methicillin, nafcillin, and oxacillin. These isolates, referred to as MRSA (methicillin resistant *S. aureus*) were first seen in the 1970s, and are now firmly established in hospital settings. Recently there have been several cases of MRSA infections in the community, where the infected individuals had no previous exposure to hospitals or healthcare workers. This alarming trend is intensified by the isolation of MRSA isolates that are less susceptible to vancomycin, a glycopeptide used to treat MRSA. Very few strains have been shown to be truly resistant to vancomycin according to the CDC's definition of vancomycin resistance, but several MRSA strains have been characterized as consisting of subpopulations with reduced susceptibility to vancomycin, or VISA (vancomycin intermediate *S. aureus*). Since the isolation of vancomycin resistant and vancomycin intermediate strains is a relatively new development, there is little data concerning their prevalence in hospitals and/or the community. Occasionally, VRSA (vancomycin resistant *S. aureus*) with full resistance to vancomycin and carrying a resistance plasmid likely acquired from *Enterococcus* spp. have also been recovered from humans.

Strategies for the Prevention and Treatment of *Staphylococcus* Infections

The emergence of numerous gram-positive pathogens that are resistant to multiple antibiotics has fueled research efforts aimed at developing preventative vaccines to protect against disease. Vaccines are designed to be administered to patients in order to elicit a long-term memory response from the immune system, so that if the pathogen is encountered at a future time, the immune system can more quickly and efficiently clear the pathogen. To date, a broadly-protective vaccine against gram-positive pathogens associated with a number of severe human diseases, particularly those disease associated with staphylococcal infections, is not available. Vaccine development approaches for the prevention of staphylococcal infections include those reporting the use of microbial surface components recognizing adhesion matrix molecules [MSCRAMMS (Nilsson et al. 1998. J Clin Invest 101:2640-9; Menzies et al. 2002. J Infect Dis 185:937-43; Fattom et al. 2004. Vaccine 22:880-7], surface polysaccharides (McKenney et al. 2000; McKenney et al. 1999. Science 284:1523-7; Maira-Litran et al. 2002. Infect Immun 70:4433-40; Maira-Litran et al. 2004. Vaccine 22:872-9; Maira-Litran et al. 2005. Infect Immure 73:6752-62) and mutated exoproteins (Lowell et al. 1996. Infect Immun 64:4686-93; Stiles et al. 2001. Infect Immun 69:2031-6; Gampfer et al. 2002. Vaccine 20:3675-84), as antigens in subunit vaccine compositions, as well as one live avirulent strain (Reinoso et al. 2002. Can J Vet Res 66:285-8) and several DNA vaccine approaches (Ohwada et al. 1999. J Antimicrob Chemother 44:767-74); Brouillette et al. 2002. Vaccine 20:2348-57; Senna et al. 2003. Vaccine 21:2661-6). Although many of these compositions have shown some degree of protection, they have achieved little cross-protection against diverse staphyloccocal strains and have additionally failed to elicit substantial immune responses in immunocompromised patients, an important at-risk population for nosocomial infections.

Figure 4:
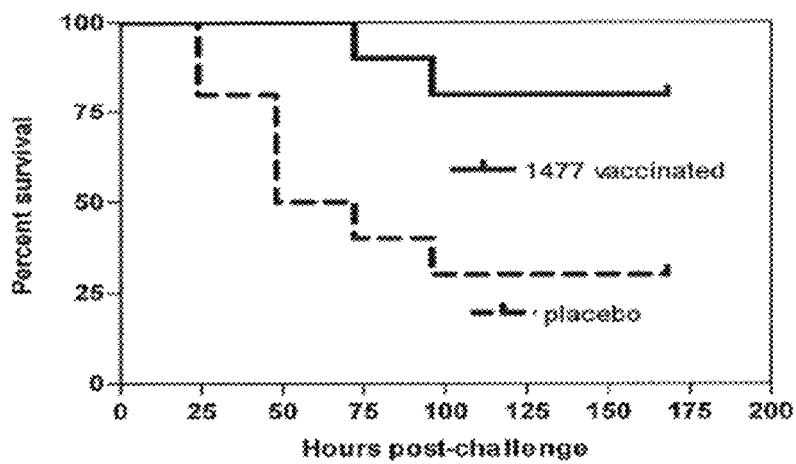

The most severe staphylococcal diseases are those mediated by the aforementioned supernantigenic pyrogenic exotoxins (SPEs) that nonspecifically stimulate T-cells independent of antigen presentation. Such diseases include toxic shock syndrome, exfoliative skin disease, and possibly Kawasaki syndrome. For these SPE-mediated diseases, immunotherapeutic agents that boost the immune system during an active infection are often more effective than vaccines, which are typically administered prior to infection. The overwhelming nature of the immune response to SPE necessitates rapid reduction in toxin activity as the first objective in therapy. To date, toxin neutralization in *S. aureus*-mediated disease has been most effectively accomplished by the administration of intravenous human immunoglobulin (IVIG), a purified, concentrated human antibody preparation from several thousand human donors (Takei et al. 1993. J Clin Invest 91:602-7; Stohl and Elliot. 1996. Clin Immunol Immunopathol 79:122-33). The widespread distribution of *S. aureus*, which colonizes approximately 30% of healthy human adults, coincides with high exposure rates for the majority of the population, so the level of anti-staphylococcal anti-toxin antibodies in IVIG is often sufficient to neutralize toxin long enough to stabilize the immune response until the bacterial load is reduced with antibiotics (Schlievert, 2001. J Allergy Clin Immunol 108(4 Suppl): S107-110). IVIG preparations from multiple manufacturers have been shown to neutralize toxin in proliferation assays with human peripheral blood mononuclear cells, inhibit toxin-induced human T cell-driven B cell differentiation in vitro (Stohl and Elliot 1996. Clin Immunol Immunopathol 79:122-33; Stohl and Elliott. 1995. J Immunol 155:1838-50; Stohl et al. 1994. J Immunol 153:117-27) and reduce IL-4 and IL-2 secretion in PBMCs stimulated with staphylococcal enterotoxin B (Takei et al. 1993. Clin Invest 91:602-7; Darenberg et al. 2004. Clin Infect Dis 38:836-42). IVIG therapy, with its proven ability to neutralize SPE, is now a recommended therapy for Kawasaki syndrome and is gaining favor as a treatment method for staphylococcal toxic shock syndrome (Schlievert 2001. J Allergy Clin Immunol 108(4 Suppl):S107-110). Use of IVIG as an immunoprotective wound lavage during surgery has also been investigated in mice (Poelstra et al. 2000. Tissue Eng 6(4):401-411). Although standard IVIG has utility for limiting the advance of some staphylococcal SPE-mediated disease, the safety, efficacy and consistency of human IVIG preparations generated from thousands of unselected human donors remains controversial (Baker et al. 1992. N Engl J Med 327:213-9; Miller et al. 2001. J Allergy Clin Immunol 108:S91-4; Sacher, 2001.1 Allergy Clin Immunol 108:S139-46; Darenberg et al. 2004. Clin Infect Dis 38:836-42). Furthermore, the benefit of IVIG in preventing some staphylococcal infections is doubtful (Baker et al. 1992. N Engl J Med 327:213-9; Hill, H. R. 2000. J Pediatr 137:595-7; Darenberg et al. 2004. Clin Infect Dis 38:836-42). In order to increase the effectiveness of IVIG in treating staphylococcal infections in certain at-risk populations, a plasma-derived, donor-selected, polyclonal anti-staphylococcal human IgG with high titers of antibody directed toward the staphylococcal MSCRAMMS clumping factor A (ClfA) and fibrinogen-binding protein G (SdrG) was created and tested with success in very low birthweight infants to prevent staphylococcal sepsis (Vemachio et al. 2003. Antimicrob Agents Chemother 47:3400-6; Bloom et al. 2005. Pediatr Infect Dis J 24:858-866; Capparelli et al. 2005. Antimicrob Agents Chemother 49:4121-7). A specific humanized monoclonal antibody toward the *S. aureus* MSCRAMM Clumping factor A, is also being developed. The antibody was selected from a pool of thousands of murine anti-ClfA antibodies for its ability to bind ClfA in a manner that abrogates *S. aureus* binding to human fibronectin and was subsequently humanized by mutating specific targeted residues to mimic the homologous human germline subgroup antibody (Hall et al. 2003. Infect Immun 71:6864-70; Domanski et al. 2005. Infect Immun 73:5229-32). The specific antibody is being designed for use in conjunction with antibiotics for the treatment of severe life-threatening *S. aureus* infection, although animal studies also demonstrated a prophylactic protective effect.

SUMMARY

In one aspect, the present invention provides compositions including two or more isolated polypeptides. An isolated polypeptide in the composition have a molecular weight as determined by electrophoresis on a sodium dodecyl sulfate-polyacrylamide gel of 88 kDa, 55 kDa, 38 kDa, 37 kDa, 36 kDa, 35 kDa, or 33 kDa. For instance, a composition may include isolated proteins of 88 kDa and 55 kDa. In some aspects the composition may include isolated polypeptides having molecular weights of 88 kDa, 55 kDa, 38 kDa, 37 kDa, 36 kDa, 35 kDa, and 33 kDa. The polypeptides are isolatable from a *Staphylococcus aureus* when incubated in media including an iron chelator and not isolatable when grown in the media without the iron chelator. The composition protects an animal, such as a mouse or cow or human, against challenge with an *S. aureus* strain such as, for instance, ATCC strain 19636. The composition may further include a pharmaceutically acceptable carrier, and may further include one or more isolated polypeptides having a molecular weight of 150 kDa, 132 kDa, 120 kDa, 75 kDa, 58 kDa, 50 kDa, 44 kDa, 43 kDa, 41 kDa, or 40 kDa and isolatable from a *S. aureus* when grown in the media without the iron chelator. In some aspects the polypeptides of the composition may be isolated from *S. aureus* ATCC strain 19636.

In some embodiments, each polypeptide of the composition has a mass fingerprint of at least 80% similarity to a mass fingerprint of a polypeptide of the same molecular weight polypeptide expressed by *Staphylococcus aureus* ATCC strain 19636, wherein the polypeptide is isolatable from a *Staphylococcus aureus* when incubated in media comprising an iron chelator and not isolatable when grown in the media without the iron chelator. For instance, the isolated polypeptide with a molecular weight of 88 kDa has a mass fingerprint of at least 80% similarity to a mass fingerprint of a 88 kDa polypeptide expressed by *Staphylococcus aureus* ATCC strain 19636, and the isolated polypeptide with a molecular weight of 55 kDa has a mass fingerprint of at least 80% similarity to a mass fingerprint of a 55 kDa polypeptide expressed by *Staphylococcus aureus* ATCC strain 19636.

In another aspect, the present invention provides compositions that include an isolated polypeptide having at least 80% sequence similarity to an amino acid sequence selected from SEQ ID NO:408 and SEQ ID NO:397. The composition may further include at least one second polypeptide, wherein the second polypeptide is isolatable from a *Staphylococcus aureus* when incubated in media comprising an iron chelator and not isolatable when grown in the media without the iron chelator. In some cases, the second polypeptide can include an amino acid sequence having at least 80% similarity to an amino acid sequence selected from SEQ ID NO:353, SEQ ID NO:364, SEQ ID NO:375, SEQ ID NO:386, and SEQ ID NO:419. In other cases, the second polypeptide can have a molecular weight as determined by electrophoresis on a sodium dodecyl sulfate-polyacrylamide gel of 88 kDa, 55 kDa, 38 kDa, 37 kDa, 36 kDa, 35 kDa, or 33 kDa. The composition may further include one or more isolated polypeptides isolatable from a *S. aureus* when grown in media without the iron chelator and has a molecular weight of 150 kDa, 132 kDa, 120 kDa, 75 kDa, 58 kDa, 50 kDa, 44 kDa, 43 kDa, 41 kDa, 40 kDa.

The present invention also provides methods for using the compositions. In one aspect the method is for treating in infection in a subject, and includes administering an effective amount of a composition of the present invention to a subject having or at risk of having an infection caused by a *Staphylococcus* spp. In another aspect, the method is for treating a symptom in a subject, and it includes administering an effective amount of a composition of the present invention to a subject having an infection caused by a *Staphylococcus* spp. The subject may be a mammal, such as a human, horse, or cow. The *Staphylococcus* spp. may be *S. aureus.*

The present invention further provides methods for using antibody, for instance, polyclonal antibody, that specifically binds polypeptides of the present invention. In one aspect, the method is for treating an infection in a subject, and includes administering an effective amount of a composition to a subject having or at risk of having an infection caused by a *Staphylococcus* spp., wherein the composition includes antibody that specifically binds at least one, and in some cases more than one, isolated polypeptide of the present invention. In another aspect, the method is for treating a symptom in a subject, and includes administering an effective amount of a composition to a subject having an infection caused by a *Staphylococcus* spp., wherein the composition includes antibody that specifically binds at least one, and in some cases more than one, isolated polypeptide of the present invention. The subject may be a mammal, such as a human, horse, or cow. The *Staphylococcus* spp. may be *S. aureus.*

Also provided by the present invention are methods for decreasing colonization in a subject. In one aspect, the method includes administering an effective amount of a composition of the present invention to a subject colonized by a *Staphylococcus* spp. In another aspect, the method includes administering an effective amount of a composition to a subject colonized by *Staphylococcus* spp., wherein the composition includes antibody that specifically binds at least one, and in some cases more than one, isolated polypeptide of the present invention.

The present invention provides a kit for detecting antibody that specifically binds a polypeptide. The kit includes, in separate containers, an isolated polypeptide of the present invention, and a reagent that detects an antibody that specifically binds the polypeptide.

BRIEF DESCRIPTION OF THE FIGURES

FIG. 1. The electrophoretic profile of the proteins of different strains *Staphylococcus aureus* derived from different species grown with and without iron (lanes marked $Fe^{++}$ and DP, respectively).

FIG. 2. The difference in mortality between vaccinated and non-vaccinated mice after homologous and heterologous challenge with *Staphylococcus aureus.*

FIG. 3. Kaplan-Meier survival curve showing percent survival after vaccination and homologous challenge with *S. aureus* ATCC 19636.

FIG. 4. Kaplan-Meier survival curve showing percent survival after vaccination and heterologous challenge with *S. aureus* ATCC 19636.

Figure 5:
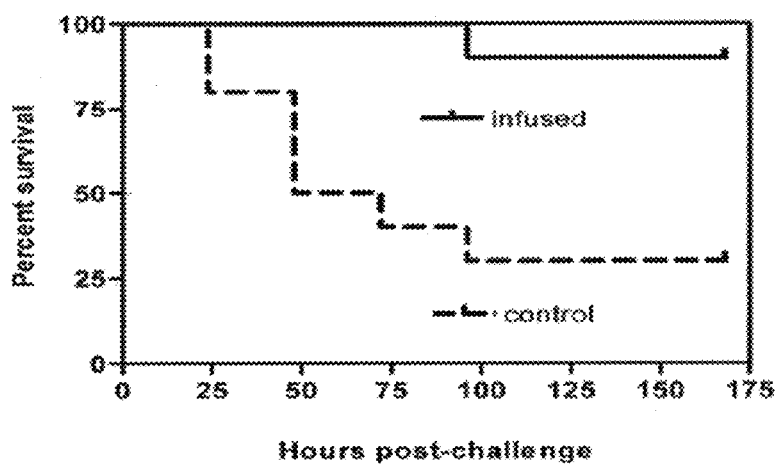

FIG. 5. Kaplan-Meier survival curve showing percent survival after passive immunization and homologous challenge with *S. aureus* ATCC 19636.

Figure 6:
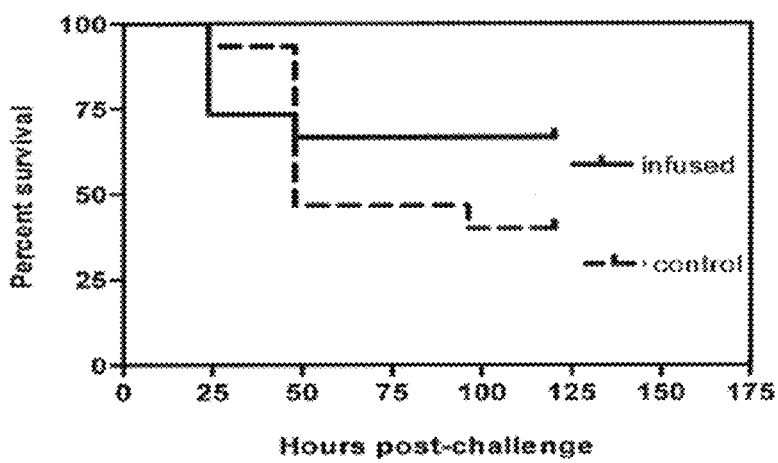

FIG. 6. Kaplan-Meier survival curve showing percent survival after passive immunization and heterologous challenge with *S. aureus* strain 1477.

FIG. 7. The amino acid sequence of a metal-regulated polypeptide obtained from *S. aureus* ATCC 19636. (SEQ ID NO:353).

FIG. 8. The amino acid sequence of a metal-regulated polypeptide obtained from *S. aureus* RF122. (SEQ ID NO:354).

FIG. 9. The amino acid sequence of a metal-regulated polypeptide obtained from *S. aureus* Mu50. (SEQ ID NO:355).

FIG. 10. The amino acid sequence of a metal-regulated polypeptide obtained from *S. aureus* MRSA252. (SEQ ID NO:356).

FIG. 11. The amino acid sequence of a metal-regulated polypeptide obtained from *S. aureus* MW2. (SEQ ID NO:357).

FIG. 12. The amino acid sequence of a metal-regulated polypeptide obtained from *S. aureus* Newman. (SEQ ID NO:358).

FIG. 13. The amino acid sequence of a metal-regulated polypeptide obtained from *S. aureus* JH9. (SEQ ID NO:359).

FIG. 14. The amino acid sequence of a metal-regulated polypeptide obtained from *S. aureus* USA300. (SEQ ID NO:360).

FIG. 15. The amino acid sequence of a metal-regulated polypeptide obtained from *S. aureus* COL. (SEQ ID NO:361).

FIG. 16. The amino acid sequence of a metal-regulated polypeptide obtained from *S. aureus* NCTC8325. (SEQ ID NO:362).

FIG. 17. The amino acid sequence of a metal-regulated polypeptide obtained from *S. aureus* MSSA476. (SEQ ID NO:363).

FIG. 18. The amino acid sequence of a metal-regulated polypeptide obtained from *S. aureus* ATCC19636. (SEQ ID NO:364).

FIG. 19. The amino acid sequence of a metal-regulated polypeptide obtained from *S. aureus* RF122. (SEQ ID NO:365).

FIG. 20. The amino acid sequence of a metal-regulated polypeptide obtained from *S. aureus* Mu50. (SEQ ID NO:366).

FIG. 21. The amino acid sequence of a metal-regulated polypeptide obtained from *S. aureus* MRSA252. (SEQ ID NO:367).

FIG. 22. The amino acid sequence of a metal-regulated polypeptide obtained from *S. aureus* MW2. (SEQ ID NO:368).

FIG. 23. The amino acid sequence of a metal-regulated polypeptide obtained from *S. aureus* Newman. (SEQ ID NO:369).

FIG. 24. The amino acid sequence of a metal-regulated polypeptide obtained from *S. aureus* JH9. (SEQ ID NO:370).

FIG. 25. The amino acid sequence of a metal-regulated polypeptide obtained from *S. aureus* USA300. (SEQ ID NO:371).

FIG. 26. The amino acid sequence of a metal-regulated polypeptide obtained from *S. aureus* COL. (SEQ ID NO:372).

FIG. 27. The amino acid sequence of a metal-regulated polypeptide obtained from *S. aureus* NCTC8325. (SEQ ID NO:373).

FIG. 28. The amino acid sequence of a metal-regulated polypeptide obtained from *S. aureus* MSSA476. (SEQ ID NO:374).

FIG. 29. The amino acid sequence of a metal-regulated polypeptide obtained from *S. aureus* ATCC19636. (SEQ ID NO:375).

FIG. 30. The amino acid sequence of a metal-regulated polypeptide obtained from *S. aureus* RF122. (SEQ ID NO:376).

FIG. 31. The amino acid sequence of a metal-regulated polypeptide obtained from *S. aureus* Mu50. (SEQ ID NO:377).

FIG. 32. The amino acid sequence of a metal-regulated polypeptide obtained from *S. aureus* MRSA252. (SEQ ID NO:378).

FIG. 33. The amino acid sequence of a metal-regulated polypeptide obtained from *S. aureus* MW2. (SEQ ID NO:379).

FIG. 34. The amino acid sequence of a metal-regulated polypeptide obtained from *S. aureus* Newman. (SEQ ID NO:380).

FIG. 35. The amino acid sequence of a metal-regulated polypeptide obtained from *S. aureus* JH9. (SEQ ID NO:381).

FIG. 36. The amino acid sequence of a metal-regulated polypeptide obtained from *S. aureus* USA300. (SEQ ID NO:382).

FIG. 37. The amino acid sequence of a metal-regulated polypeptide obtained from *S. aureus* COL. (SEQ ID NO:383).

FIG. 38. The amino acid sequence of a metal-regulated polypeptide obtained from *S. aureus* NCTC8325. (SEQ ID NO:384).

FIG. 39. The amino acid sequence of a metal-regulated polypeptide obtained from *S. aureus* MSSA476. (SEQ ID NO:385).

FIG. 40. The amino acid sequence of a metal-regulated polypeptide obtained from *S. aureus* ATCC19636. (SEQ ID NO:386).

FIG. 41. The amino acid sequence of a metal-regulated polypeptide obtained from *S. aureus* RF122. (SEQ ID NO:387).

FIG. 42. The amino acid sequence of a metal-regulated polypeptide obtained from *S. aureus* Mu50. (SEQ ID NO:388).

FIG. 43. The amino acid sequence of a metal-regulated polypeptide obtained from *S. aureus* MRSA252. (SEQ ID NO:389).

FIG. 44. The amino acid sequence of a metal-regulated polypeptide obtained from *S. aureus* MW2. (SEQ ID NO:390).

FIG. 45. The amino acid sequence of a metal-regulated polypeptide obtained from *S. aureus* Newman. (SEQ ID NO:391).

FIG. 46. The amino acid sequence of a metal-regulated polypeptide obtained from *S. aureus* JH9. (SEQ ID NO:392).

FIG. 47. The amino acid sequence of a metal-regulated polypeptide obtained from *S. aureus* USA300. (SEQ ID NO:393).

FIG. 48. The amino acid sequence of a metal-regulated polypeptide obtained from *S. aureus* COL. (SEQ ID NO:394).

FIG. 49. The amino acid sequence of a metal-regulated polypeptide obtained from *S. aureus* NCTC8325. (SEQ ID NO:395).

FIG. 50. The amino acid sequence of a metal-regulated polypeptide obtained from *S. aureus* MSSA476. (SEQ ID NO:396).

FIG. 51. The amino acid sequence of a metal-regulated polypeptide obtained from *S. aureus* ATCC19636. (SEQ ID NO:397).

FIG. 52. The amino acid sequence of a metal-regulated polypeptide obtained from *S. aureus* RF122. (SEQ ID NO:398).

FIG. 53. The amino acid sequence of a metal-regulated polypeptide obtained from *S. aureus* Mu50. (SEQ ID NO:399).

FIG. 54. The amino acid sequence of a metal-regulated polypeptide obtained from *S. aureus* MRSA252. (SEQ ID NO:400).

FIG. 55. The amino acid sequence of a metal-regulated polypeptide obtained from *S. aureus* MW2. (SEQ ID NO:401).

FIG. 56. The amino acid sequence of a metal-regulated polypeptide obtained from *S. aureus* Newman. (SEQ ID NO:402).

FIG. 57. The amino acid sequence of a metal-regulated polypeptide obtained from *S. aureus* JH9. (SEQ ID NO:403).

FIG. 58. The amino acid sequence of a metal-regulated polypeptide obtained from *S. aureus* USA300. (SEQ ID NO:404).

FIG. 59. The amino acid sequence of a metal-regulated polypeptide obtained from *S. aureus* COL. (SEQ ID NO:405).

FIG. 60. The amino acid sequence of a metal-regulated polypeptide obtained from *S. aureus* NCTC8325. (SEQ ID NO:406).

FIG. 61. The amino acid sequence of a metal-regulated polypeptide obtained from *S. aureus* MSSA476. (SEQ ID NO:407).

FIG. 62. The amino acid sequence of a metal-regulated polypeptide obtained from *S. aureus* ATCC19636. (SEQ ID NO:408).

FIG. 63. The amino acid sequence of a metal-regulated polypeptide obtained from *S. aureus* RF122. (SEQ ID NO:409).

FIG. 64. The amino acid sequence of a metal-regulated polypeptide obtained from *S. aureus* Mu50. (SEQ ID NO:410).

FIG. 65. The amino acid sequence of a metal-regulated polypeptide obtained from *S. aureus* MRSA252. (SEQ ID NO:411).

FIG. 66. The amino acid sequence of a metal-regulated polypeptide obtained from *S. aureus* MW2. (SEQ ID NO:412).

FIG. 67. The amino acid sequence of a metal-regulated polypeptide obtained from *S. aureus* Newman. (SEQ ID NO:413).

FIG. 68. The amino acid sequence of a metal-regulated polypeptide obtained from *S. aureus* JH9. (SEQ ID NO:414).

FIG. 69. The amino acid sequence of a metal-regulated polypeptide obtained from *S. aureus* USA300. (SEQ ID NO:415).

FIG. 70. The amino acid sequence of a metal-regulated polypeptide obtained from *S. aureus* COL. (SEQ ID NO:416).

FIG. 71. The amino acid sequence of a metal-regulated polypeptide obtained from *S. aureus* NCTC8325. (SEQ ID NO:417).

FIG. 72. The amino acid sequence of a metal-regulated polypeptide obtained from *S. aureus* MSSA476. (SEQ ID NO:418).

FIG. 73. The amino acid sequence of a metal-regulated polypeptide obtained from *S. aureus* ATCC19636. (SEQ ID NO:419).

FIG. 74. The amino acid sequence of a metal-regulated polypeptide obtained from *S. aureus* RF122. (SEQ ID NO:420).

FIG. 75. The amino acid sequence of a metal-regulated polypeptide obtained from *S. aureus* Mu50. (SEQ ID NO:421).

FIG. 76. The amino acid sequence of a metal-regulated polypeptide obtained from *S. aureus* MRSA252. (SEQ ID NO:422).

FIG. 77. The amino acid sequence of a metal-regulated polypeptide obtained from *S. aureus* MW2. (SEQ ID NO:423).

FIG. 78. The amino acid sequence of a metal-regulated polypeptide obtained from *S. aureus* Newman. (SEQ ID NO:424).

FIG. 79. The amino acid sequence of a metal-regulated polypeptide obtained from *S. aureus* JH9. (SEQ ID NO:425).

FIG. 80. The amino acid sequence of a metal-regulated polypeptide obtained from *S. aureus* USA300. (SEQ ID NO:426).

FIG. 81. The amino acid sequence of a metal-regulated polypeptide obtained from *S. aureus* COL. (SEQ ID NO:427).

FIG. 82. The amino acid sequence of a metal-regulated polypeptide obtained from *S. aureus* NCTC8325. (SEQ ID NO:428).

FIG. 83. The amino acid sequence of a metal-regulated polypeptide obtained from *S. aureus* MSSA476. (SEQ ID NO:429).

FIG. 84. A nucleic acid sequence encoding a metal-regulated polypeptide obtained from *S. aureus* ATCC 19636. (SEQ ID NO:430).

FIG. 85. A nucleic acid sequence encoding a metal-regulated polypeptide obtained from *S. aureus* RF122. (SEQ ID NO:431).

FIG. 86. A nucleic acid sequence encoding a metal-regulated polypeptide obtained from *S. aureus* Mu50. (SEQ ID NO:432).

FIG. 87. A nucleic acid sequence encoding a metal-regulated polypeptide obtained from *S. aureus* MRSA252. (SEQ ID NO:433).

FIG. 88. A nucleic acid sequence encoding a metal-regulated polypeptide obtained from *S. aureus* MW2. (SEQ ID NO:434).

FIG. 89. A nucleic acid sequence encoding a metal-regulated polypeptide obtained from *S. aureus* Newman. (SEQ ID NO:435).

FIG. 90. A nucleic acid sequence encoding a metal-regulated polypeptide obtained from *S. aureus* JH9. (SEQ ID NO:436).

FIG. 91. A nucleic acid sequence encoding a metal-regulated polypeptide obtained from *S. aureus* USA300. (SEQ ID NO:437).

FIG. 92. A nucleic acid sequence encoding a metal-regulated polypeptide obtained from *S. aureus* COL. (SEQ ID NO:438).

FIG. 93. A nucleic acid sequence encoding a metal-regulated polypeptide obtained from *S. aureus* NCTC8325. (SEQ ID NO:439).

FIG. 94. A nucleic acid sequence encoding a metal-regulated polypeptide obtained from *S. aureus* MSSA476. (SEQ ID NO:440).

FIG. 95. A nucleic acid sequence encoding a metal-regulated polypeptide obtained from *S. aureus* ATCC19636. (SEQ ID NO:441).

FIG. 96. A nucleic acid sequence encoding a metal-regulated polypeptide obtained from *S. aureus* RF122. (SEQ ID NO:442).

FIG. 97. A nucleic acid sequence encoding a metal-regulated polypeptide obtained from *S. aureus* Mu50. (SEQ ID NO:443).

FIG. 98. A nucleic acid sequence encoding a metal-regulated polypeptide obtained from *S. aureus* MRSA252. (SEQ ID NO:444).

FIG. 99. A nucleic acid sequence encoding a metal-regulated polypeptide obtained from *S. aureus* MW2. (SEQ ID NO:445).

FIG. 100. A nucleic acid sequence encoding a metal-regulated polypeptide obtained from *S. aureus* Newman. (SEQ ID NO:446).

FIG. 101. A nucleic acid sequence encoding a metal-regulated polypeptide obtained from *S. aureus* JH9. (SEQ ID NO:447).

FIG. 102. A nucleic acid sequence encoding a metal-regulated polypeptide obtained from *S. aureus* USA300. (SEQ ID NO:448).

FIG. 103. A nucleic acid sequence encoding a metal-regulated polypeptide obtained from *S. aureus* COL. (SEQ ID NO:449).

FIG. 104. A nucleic acid sequence encoding a metal-regulated polypeptide obtained from *S. aureus* NCTC8325. (SEQ ID NO:450).

FIG. 105. A nucleic acid sequence encoding a metal-regulated polypeptide obtained from *S. aureus* MSSA476. (SEQ ID NO:451).

FIG. 106. A nucleic acid sequence encoding a metal-regulated polypeptide obtained from *S. aureus* ATCC19636. (SEQ ID NO:452).

FIG. 107. A nucleic acid sequence encoding a metal-regulated polypeptide obtained from *S. aureus* RF122. (SEQ ID NO:453).

FIG. 108. A nucleic acid sequence encoding a metal-regulated polypeptide obtained from *S. aureus* Mu50. (SEQ ID NO:454).

FIG. 109. A nucleic acid sequence encoding a metal-regulated polypeptide obtained from *S. aureus* MRSA252. (SEQ ID NO:455).

FIG. 110. A nucleic acid sequence encoding a metal-regulated polypeptide obtained from *S. aureus* MW2. (SEQ ID NO:456).

FIG. 111. A nucleic acid sequence encoding a metal-regulated polypeptide obtained from *S. aureus* Newman. (SEQ ID NO:457).

FIG. 112. A nucleic acid sequence encoding a metal-regulated polypeptide obtained from *S. aureus* JH9. (SEQ ID NO:458).

FIG. 113. A nucleic acid sequence encoding a metal-regulated polypeptide obtained from *S. aureus* USA300. (SEQ ID NO:459).

FIG. 114. A nucleic acid sequence encoding a metal-regulated polypeptide obtained from *S. aureus* COL. (SEQ ID NO:460).

FIG. 115. A nucleic acid sequence encoding a metal-regulated polypeptide obtained from *S. aureus* NCTC8325. (SEQ ID NO:461).

FIG. 116. A nucleic acid sequence encoding a metal-regulated polypeptide obtained from *S. aureus* MSSA476. (SEQ ID NO:462).

FIG. 117. A nucleic acid sequence encoding a metal-regulated polypeptide obtained from *S. aureus* ATCC19636. (SEQ ID NO:463).

FIG. 118. A nucleic acid sequence encoding a metal-regulated polypeptide obtained from *S. aureus* RF122. (SEQ ID NO:464).

FIG. 119. A nucleic acid sequence encoding a metal-regulated polypeptide obtained from *S. aureus* Mu50. (SEQ ID NO:465).

FIG. 120. A nucleic acid sequence encoding a metal-regulated polypeptide obtained from *S. aureus* MRSA252. (SEQ ID NO:466).

FIG. 121. A nucleic acid sequence encoding a metal-regulated polypeptide obtained from *S. aureus* MW2. (SEQ ID NO:467).

FIG. 122. A nucleic acid sequence encoding a metal-regulated polypeptide obtained from *S. aureus* Newman. (SEQ ID NO:468).

FIG. 123. A nucleic acid sequence encoding a metal-regulated polypeptide obtained from *S. aureus* JH9. (SEQ ID NO:469).

FIG. 124. A nucleic acid sequence encoding a metal-regulated polypeptide obtained from *S. aureus* USA300. (SEQ ID NO:470).

FIG. 125. A nucleic acid sequence encoding a metal-regulated polypeptide obtained from *S. aureus* COL. (SEQ ID NO:471).

FIG. 126. A nucleic acid sequence encoding a metal-regulated polypeptide obtained from *S. aureus* NCTC8325. (SEQ ID NO:472).

FIG. 127. A nucleic acid sequence encoding a metal-regulated polypeptide obtained from *S. aureus* MSSA476. (SEQ ID NO:473).

FIG. 128. A nucleic acid sequence encoding a metal-regulated polypeptide obtained from *S. aureus* ATCC19636. (SEQ ID NO:474).

FIG. 129. A nucleic acid sequence encoding a metal-regulated polypeptide obtained from *S. aureus* RF122. (SEQ ID NO:475).

FIG. 130. A nucleic acid sequence encoding a metal-regulated polypeptide obtained from *S. aureus* Mu50. (SEQ ID NO:476).

FIG. 131. A nucleic acid sequence encoding a metal-regulated polypeptide obtained from *S. aureus* MRSA252. (SEQ ID NO:477).

FIG. 132. A nucleic acid sequence encoding a metal-regulated polypeptide obtained from *S. aureus* MW2. (SEQ ID NO:478).

FIG. 133. A nucleic acid sequence encoding a metal-regulated polypeptide obtained from *S. aureus* Newman. (SEQ ID NO:479).

FIG. 134. A nucleic acid sequence encoding a metal-regulated polypeptide obtained from *S. aureus* JH9. (SEQ ID NO:480).

FIG. 135. A nucleic acid sequence encoding a metal-regulated polypeptide obtained from *S. aureus* USA300. (SEQ ID NO:481).

FIG. 136. A nucleic acid sequence encoding a metal-regulated polypeptide obtained from *S. aureus* COL. (SEQ ID NO:482).

FIG. 137. A nucleic acid sequence encoding a metal-regulated polypeptide obtained from *S. aureus* NCTC8325. (SEQ ID NO:483).

FIG. 138. A nucleic acid sequence encoding a metal-regulated polypeptide obtained from *S. aureus* MSSA476. (SEQ ID NO:484).

FIG. 139. A nucleic acid sequence encoding a metal-regulated polypeptide obtained from *S. aureus* ATCC19636. (SEQ ID NO:485).

FIG. 140. A nucleic acid sequence encoding a metal-regulated polypeptide obtained from *S. aureus* RF122. (SEQ ID NO:486).

FIG. 141. A nucleic acid sequence encoding a metal-regulated polypeptide obtained from *S. aureus* Mu50. (SEQ ID NO:487).

FIG. 142. A nucleic acid sequence encoding a metal-regulated polypeptide obtained from *S. aureus* MRSA252. (SEQ ID NO:488).

FIG. 143. A nucleic acid sequence encoding a metal-regulated polypeptide obtained from *S. aureus* MW2. (SEQ ID NO:489).

FIG. 144. A nucleic acid sequence encoding a metal-regulated polypeptide obtained from *S. aureus* Newman. (SEQ ID NO:490).

FIG. 145. A nucleic acid sequence encoding a metal-regulated polypeptide obtained from *S. aureus* JH9. (SEQ ID NO:491).

FIG. 146. A nucleic acid sequence encoding a metal-regulated polypeptide obtained from *S. aureus* USA300. (SEQ ID NO:492).

FIG. 147. A nucleic acid sequence encoding a metal-regulated polypeptide obtained from *S. aureus* COL. (SEQ ID NO:493).

FIG. 148. A nucleic acid sequence encoding a metal-regulated polypeptide obtained from *S. aureus* NCTC8325. (SEQ ID NO:494).

FIG. 149. A nucleic acid sequence encoding a metal-regulated polypeptide obtained from *S. aureus* MSSA476. (SEQ ID NO:495).

FIG. 150. A nucleic acid sequence encoding a metal-regulated polypeptide obtained from *S. aureus* ATCC19636. (SEQ ID NO:496).

FIG. 151. A nucleic acid sequence encoding a metal-regulated polypeptide obtained from *S. aureus* RF122. (SEQ ID NO:497).

FIG. 152. A nucleic acid sequence encoding a metal-regulated polypeptide obtained from *S. aureus* Mu50. (SEQ ID NO:498).

FIG. 153. A nucleic acid sequence encoding a metal-regulated polypeptide obtained from *S. aureus* MRSA252. (SEQ ID NO:499).

FIG. 154. A nucleic acid sequence encoding a metal-regulated polypeptide obtained from *S. aureus* MW2. (SEQ ID NO:500).

FIG. 155. A nucleic acid sequence encoding a metal-regulated polypeptide obtained from *S. aureus* Newman. (SEQ ID NO:501).

FIG. 156. A nucleic acid sequence encoding a metal-regulated polypeptide obtained from *S. aureus* JH9. (SEQ ID NO:502).

FIG. 157. A nucleic acid sequence encoding a metal-regulated polypeptide obtained from *S. aureus* USA300. (SEQ ID NO:503).

FIG. 158. A nucleic acid sequence encoding a metal-regulated polypeptide obtained from *S. aureus* COL. (SEQ ID NO:504).

FIG. 159. A nucleic acid sequence encoding a metal-regulated polypeptide obtained from *S. aureus* NCTC8325. (SEQ ID NO:505).

FIG. 160. A nucleic acid sequence encoding a metal-regulated polypeptide obtained from *S. aureus* MSSA476. (SEQ ID NO:506).

FIG. 161. Kaplan-Meier survival curves showing percent survival after passive immunization and homologous challenge with *S. aureus* ATCC 25904. A, intravenous challenge after vaccination with rMntC; B, intraperitoneal challenge after 2× vaccination with SIRP extract, 2× vaccination with rSIRP7, or 3× vaccination with rSIRP7; C, intravenous challenge after vaccination with rSIRP7.

FIG. 162. The amino acid sequence of a metal-regulated polypeptide obtained from *S. aureus* RF122. (SEQ ID NO:543).

FIG. 163. The amino acid sequence of a metal-regulated polypeptide obtained from *S. aureus* Mu50. (SEQ ID NO:544).

FIG. 164. The amino acid sequence of a metal-regulated polypeptide obtained from *S. aureus* MRSA252. (SEQ ID NO:545).

FIG. 165. The amino acid sequence of a metal-regulated polypeptide obtained from *S. aureus* MW2. (SEQ ID NO:546).

FIG. 166. The amino acid sequence of a metal-regulated polypeptide obtained from *S. aureus* Newman. (SEQ ID NO:547).

FIG. 167. The amino acid sequence of a metal-regulated polypeptide obtained from *S. aureus* JH9. (SEQ ID NO:548).

FIG. 168. The amino acid sequence of a metal-regulated polypeptide obtained from *S. aureus* USA300. (SEQ ID NO:549).

FIG. 169. The amino acid sequence of a metal-regulated polypeptide obtained from *S. aureus* COL. (SEQ ID NO:550).

FIG. 170. The amino acid sequence of a metal-regulated polypeptide obtained from *S. aureus* NCTC8325. (SEQ ID NO:551).

FIG. 171. The amino acid sequence of a metal-regulated polypeptide obtained from *S. aureus* MSSA476. (SEQ ID NO:552).

FIG. 172. The amino acid sequence of a metal-regulated polypeptide obtained from *S. aureus* RF122. (SEQ ID NO:553).

FIG. 173. The amino acid sequence of a metal-regulated polypeptide obtained from *S. aureus* Mu50. (SEQ ID NO:554).

FIG. 174. The amino acid sequence of a metal-regulated polypeptide obtained from *S. aureus* MRSA252. (SEQ ID NO:555).

FIG. 175. The amino acid sequence of a metal-regulated polypeptide obtained from *S. aureus* MW2. (SEQ ID NO:556).

FIG. 176. The amino acid sequence of a metal-regulated polypeptide obtained from *S. aureus* Newman. (SEQ ID NO:557).

FIG. 177. The amino acid sequence of a metal-regulated polypeptide obtained from *S. aureus* JH9. (SEQ ID NO:558).

FIG. 178. The amino acid sequence of a metal-regulated polypeptide obtained from *S. aureus* USA300. (SEQ ID NO:559).

FIG. 179. The amino acid sequence of a metal-regulated polypeptide obtained from *S. aureus* COL. (SEQ ID NO:560).

FIG. 180. The amino acid sequence of a metal-regulated polypeptide obtained from *S. aureus* NCTC8325. (SEQ ID NO:561).

FIG. 181. The amino acid sequence of a metal-regulated polypeptide obtained from *S. aureus* MSSA476. (SEQ ID NO:562).

FIG. 182. A nucleic acid sequence encoding a metal-regulated polypeptide obtained from *S. aureus* RF122. (SEQ ID NO:563).

FIG. 183. A nucleic acid sequence encoding a metal-regulated polypeptide obtained from *S. aureus* Mu50. (SEQ ID NO:564).

FIG. 184. A nucleic acid sequence encoding a metal-regulated polypeptide obtained from *S. aureus* MRSA252. (SEQ ID NO:565).

FIG. 185. A nucleic acid sequence encoding a metal-regulated polypeptide obtained from *S. aureus* MW2. (SEQ ID NO:566).

FIG. 186. A nucleic acid sequence encoding a metal-regulated polypeptide obtained from *S. aureus* Newman. (SEQ ID NO:567).

FIG. 187. A nucleic acid sequence encoding a metal-regulated polypeptide obtained from *S. aureus* JH9. (SEQ ID NO:568).

FIG. 188. A nucleic acid sequence encoding a metal-regulated polypeptide obtained from *S. aureus* USA300. (SEQ ID NO:569).

FIG. 189. A nucleic acid sequence encoding a metal-regulated polypeptide obtained from *S. aureus* COL. (SEQ ID NO:570).

FIG. 190. A nucleic acid sequence encoding a metal-regulated polypeptide obtained from *S. aureus* NCTC8325. (SEQ ID NO:571).

FIG. 191. A nucleic acid sequence encoding a metal-regulated polypeptide obtained from *S. aureus* MSSA476. (SEQ ID NO:572).

FIG. 192. A nucleic acid sequence encoding a metal-regulated polypeptide obtained from *S. aureus* RF122. (SEQ ID NO:573).

FIG. 193. A nucleic acid sequence encoding a metal-regulated polypeptide obtained from *S. aureus* Mu50. (SEQ ID NO:574).

FIG. 194. A nucleic acid sequence encoding a metal-regulated polypeptide obtained from *S. aureus* MRSA252. (SEQ ID NO:575).

FIG. 195. A nucleic acid sequence encoding a metal-regulated polypeptide obtained from *S. aureus* MW2. (SEQ ID NO:576).

FIG. 196. A nucleic acid sequence encoding a metal-regulated polypeptide obtained from *S. aureus* Newman. (SEQ ID NO:577).

FIG. 197. A nucleic acid sequence encoding a metal-regulated polypeptide obtained from *S. aureus* JH9. (SEQ ID NO:578).

FIG. 198. A nucleic acid sequence encoding a metal-regulated polypeptide obtained from *S. aureus* USA300. (SEQ ID NO:579).

FIG. 199. A nucleic acid sequence encoding a metal-regulated polypeptide obtained from *S. aureus* COL. (SEQ ID NO:580).

FIG. 200. A nucleic acid sequence encoding a metal-regulated polypeptide obtained from *S. aureus* NCTC8325. (SEQ ID NO:581).

FIG. 201. A nucleic acid sequence encoding a metal-regulated polypeptide obtained from *S. aureus* MSSA476. (SEQ ID NO:582).

Figure 202:
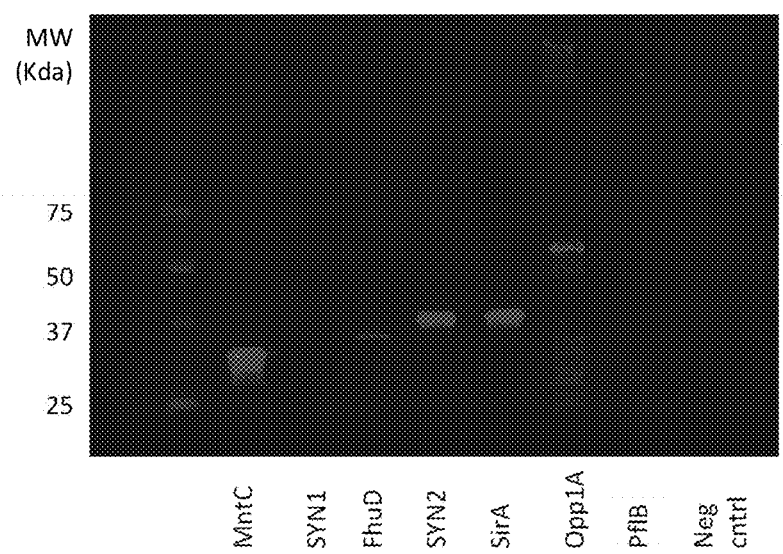

FIG. 202. A Western blot showing binding of mouse convalescent sera to recombinantly-produced metal-regulated polypeptides.

Figure 203:
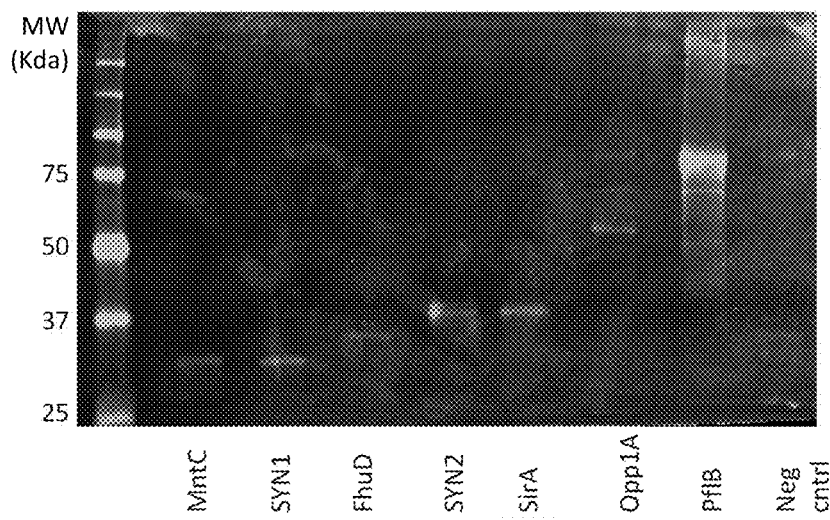

FIG. 203. A Western blot showing binding of sera from healthy humans to recombinantly-produced metal-regulated polypeptides.

Figure 204:
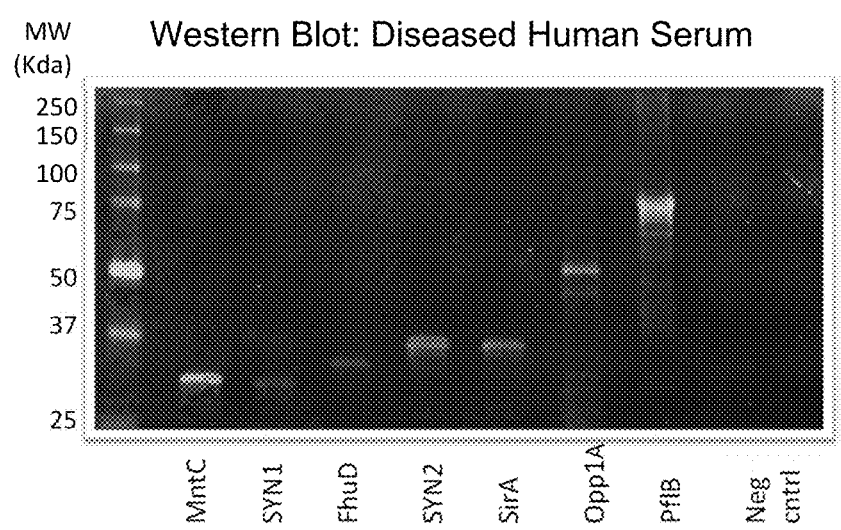

FIG. 204. A Western blot showing binding of sera from convalescent humans to recombinantly-produced metal-regulated polypeptides.

Figure 205:
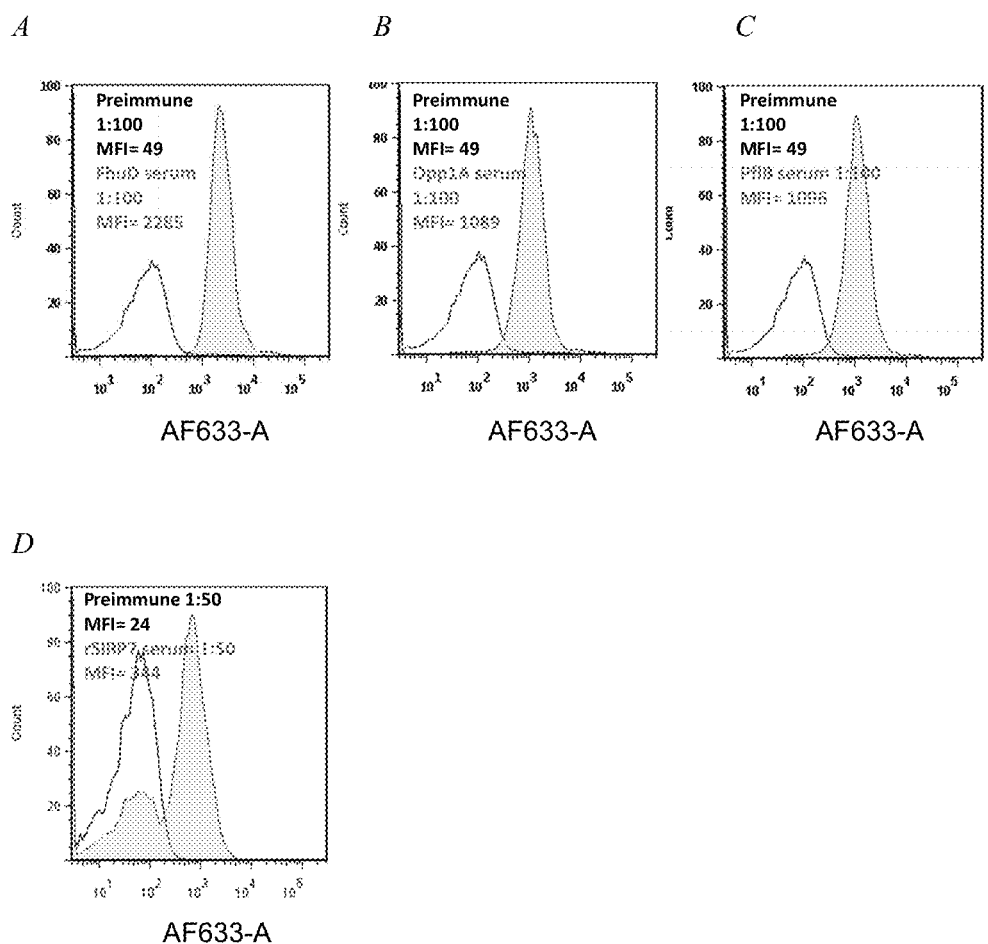

FIG. 205. Flow cytometry data showing *S. aureus* DU5875 surface expression of metal-regualted polypeptides.

Figure 206:
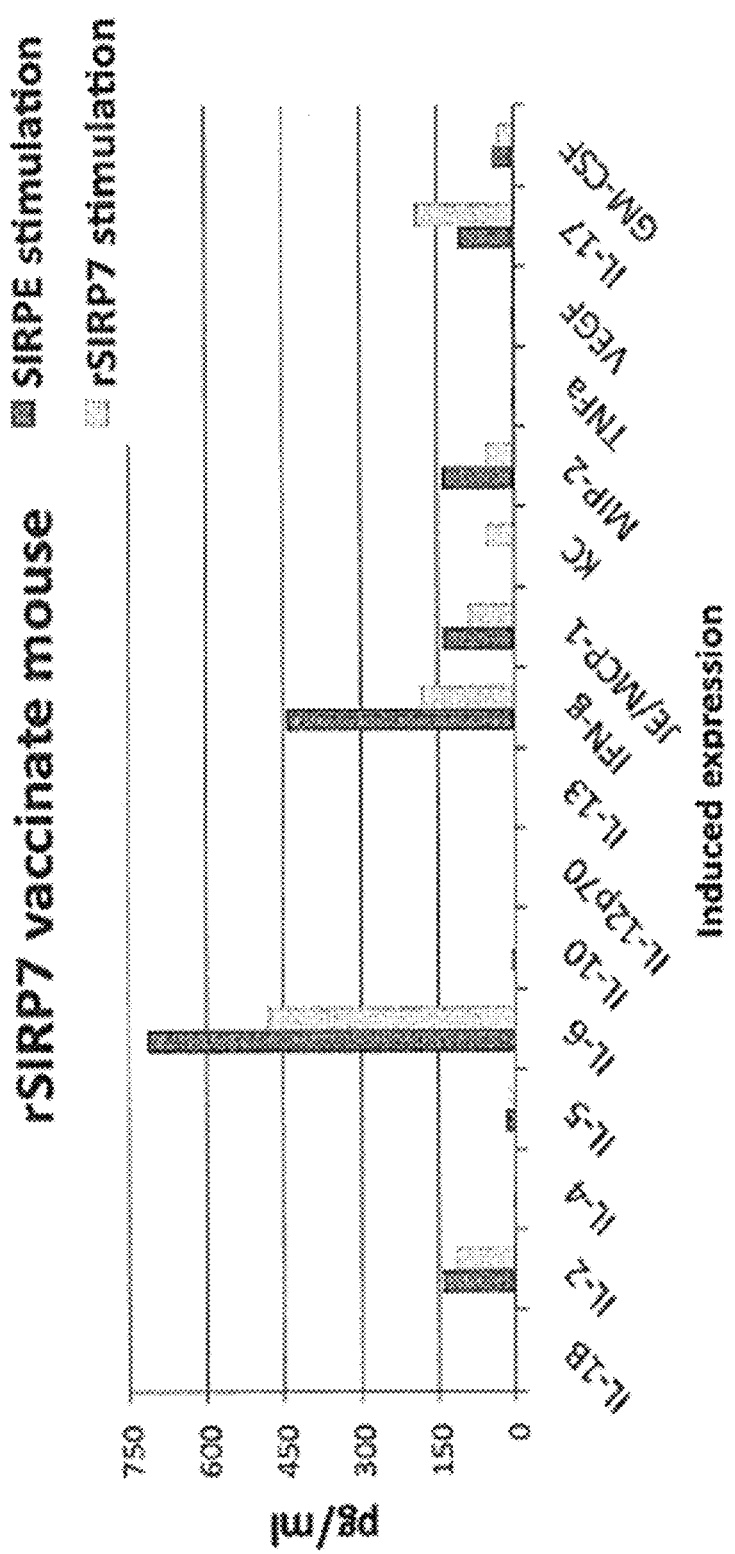

FIG. 206. Cytokine induction following vaccination with rSIRP7 and restimulation with either SIRPextract or rSIRP7.

DETAILED DESCRIPTION OF PREFERRED EMBODIMENTS OF THE INVENTION

The present invention provides polypeptides and compositions including polypeptides. As used herein, "polypeptide" refers to a polymer of amino acids linked by peptide bonds. Thus, for example, the terms peptide, oligopeptide, protein, and enzyme are included within the definition of polypeptide. This term also includes post-expression modifications of the polypeptide, such as glycosylations, acetylations, phosphorylations, and the like. The term polypeptide does not connote a specific length of a polymer of amino acids. A polypeptide may be isolatable directly from a natural source, or can be prepared with the aid of recombinant, enzymatic, or chemical techniques. In the case of a polypeptide that is naturally occurring, such a polypeptide is typically isolated.

An "isolated" polypeptide is one that has been removed from its natural environment. For instance, an isolated polypeptide is a polypeptide that has been removed from the cytoplasm or from the membrane of a cell, and many of the polypeptides, nucleic acids, and other cellular material of its natural environment are no longer present.

A polypeptide characterized as "isolatable" from a particular source is a polypeptide that, under appropriate conditions, is produced by the identified source, although the polypeptide may be obtained from alternate sources using, for example, recombinant, chemical, or enzymatic techniques well know to those skilled in the art. Thus, characterizing a polypeptide as "isolatable" from a particular source does not imply any specific source from which the polypeptide must be obtained or any particular conditions or processes under which the polypeptide must be obtained.

A "purified" polypeptide is one that is at least 60% free, preferably at least 75% free, and most preferably at least 90% free from other components with which they are naturally associated. Polypeptides that are produced outside the organism in which they naturally occur, e.g., through chemical or recombinant means, are considered to be isolated and purified by definition, since they were never present in a natural environment.

As used herein, a "polypeptide fragment" refers to a portion of a polypeptide that results from digestion of a polypeptide with a protease.

Unless otherwise specified, "a," "an," "the," and "at least one" are used interchangeably and mean one or more than one. The terms "comprises" and variations thereof do not have a limiting meaning where these terms appear in the description and claims.

A polypeptide of the present invention may be characterized by molecular weight, mass fingerprint, amino acid sequence, nucleic acid that encodes the polypeptide, immunological activity, or any combination of two or more such characteristics. The molecular weight of a polypeptide, typically expressed in kilodaltons (kDa), can be determined using routine methods including, for instance, gel filtration, gel electrophoresis including sodium dodecyl sulfate (SDS) polyacrylamide gel electrophoresis (PAGE), capillary electrophoresis, mass spectrometry, liquid chromatography (including HPLC), and calculating the molecular weight from an observed or predicted amino acid sequence. Unless indicated otherwise, molecular weight refers to molecular weight as determined by resolving a polypeptide using an SDS polyacrylamide gel having a stacking gel of about 4% and a resolving gel of about 10% under reducing and denaturing conditions.

As used herein, a "mass fingerprint" refers to a population of polypeptide fragments obtained from a polypeptide after digestion with a protease. Typically, the polypeptide fragments resulting from a digestion are analyzed using a mass spectrometric method. Each polypeptide fragment is characterized by a mass, or by a mass (m) to charge (z) ratio, which is referred to as an "m/z ratio" or an "m/z value." Methods for generating a mass fingerprint of a polypeptide are routine. An example of such a method is disclosed in Example 13.

A polypeptide of the present invention may be a metal-regulated polypeptide. As used herein, a "metal-regulated polypeptide" is a polypeptide that is expressed by a microbe at a greater level when the microbe is grown in low metal conditions compared to growth of the same microbe in high metal conditions. Low metal and high metal conditions are described herein. For instance, one class of metal-regulated polypeptide produced by *Staphylococcus* spp. is not expressed at detectable levels during growth of the microbe in high metal conditions but is expressed at detectable levels during growth in low metal conditions.

Examples of metal-regulated polypeptides isolatable from *S. aureus* after growth in low iron conditions have molecular weights of 88 kDa, 55 kDa, 38 kDa, 37 kDa, 36 kDa, 35 kDa, and 33 kDa. Examples of metal-regulated polypeptides isolatable from *S. aureus* after growth in low zinc or low copper conditions have molecular weights of 115 kDa, 88 kDa, 80 kDa, 71 kDa, 69 kDa, 35 kDa, 30 kDa, 29, kDa, and 27 kDa.

Additional examples of metal-regulated polypeptides include recombinantly-produced versions of polypeptides described herein. A recombinantly-produced polypeptide may include the entire amino acid sequence translatable from an mRNA transcript. Alternatively, a recombinantly-produced metal-regulated polypeptide can include a fragment or portion of the entire translatable amino acid sequence. For example, a recombinantly-produced metal-regulated polypeptide may lack a cleavable sequence at either terminal of the polypeptide—e.g., a cleavable signal sequence at the amino terminal of the polypeptide.

Thus, a metal-regulated polypeptide can be a polypeptide that includes the amino acid sequence depicted in, for example, SEQ ID NO:353, SEQ ID NO:364, SEQ ID NO:375, SEQ ID NO:386, SEQ ID NO:397, SEQ ID NO:408, and SEQ ID NO:419.

The present invention also includes polypeptides that are not metal-regulated. Such polypeptides are expressed in the presence of a metal ion such as, for example, in the presence of ferric chloride, and also expressed when grown in low iron conditions. Examples of such polypeptides isolatable from *S. aureus* have molecular weights of 150 kDa, 132 kDa, 120 kDa, 75 kDa, 58 kDa, 50 kDa, 44 kDa, 43 kDa, 41 kDa, and 40 kDa.

Whether a polypeptide is a metal-regulated polypeptide or not can be determined by methods useful for comparing the presence of polypeptides, including, for example, gel filtration, gel electrophoresis including sodium dodecyl sulfate-polyacrylamide gel electrophoresis (SDS-PAGE), capillary electrophoresis, mass spectrometry, and liquid chromatography including HPLC. Separate cultures of a microbe are grown under high metal conditions and under low metal conditions, polypeptides of the present invention are isolated as described herein, and the polypeptides present in each culture are resolved and compared. Typically, an equal amount of polypeptides from each culture is used. Preferably, the polypeptides are resolved using an SDS polyacrylamide gel having a stacking gel of about 4% and a resolving gel of about 10% under reducing and denaturing conditions. For instance, 30 micrograms (μg) of total polypeptide from each culture may be used and loaded into wells of a gel. After running the gel and staining the polypeptides with COOMASSIE Brilliant Blue, the two lanes can be compared. When determining whether a polypeptide is or is not expressed at a detectable level, 30 μg of total polypeptide from a culture is resolved on an SDS-PAGE gel and stained with COOMASSIE Brilliant Blue using methods known in the art. A polypeptide that can be visualized by eye is considered to be expressed at a detectable level, while a polypeptide that cannot be visualized by eye is considered to not be expressed at a detectable level.

Alternatively, whether a polypeptide is metal-regulated or not can be determined using microarray-based gene expression analysis. Separate cultures of a microbe are grown under high metal conditions and under low metal conditions, RNA is extracted from cells of each culture, and differences in RNA expression in cells grown in high metal conditions versus RNA expression in cells grown in low metal conditions are detected and compared. For example, labeled cDNA can be prepared from 8-10 μg of bacterial RNA using established protocols. The labeled cDNA can be applied to a microarray of the *S. aureus* genome. Such microarrays are commercially available and gene expression using such arrays is routine.

Polypeptides of the present invention may have immunological activity. "Immunological activity" refers to the ability of a polypeptide to elicit an immunological response in an animal. An immunological response to a polypeptide is the development in an animal of a cellular and/or antibody-mediated immune response to the polypeptide. Usually, an immunological response includes but is not limited to one or more of the following effects: the production of antibodies, B cells, helper T cells, suppressor T cells, and/or cytotoxic T cells, directed to an epitope or epitopes of the polypeptide. "Epitope" refers to the site on an antigen to which specific B cells and/or T cells respond so that antibody is produced. The immunological activity may be protective. "Protective immunological activity" refers to the ability of a polypeptide to elicit an immunological response in an animal that prevents or inhibits infection by *Staphylococcus* spp., for instance, *S. aureus*. Whether a polypeptide has protective immunological activity can be determined by methods known in the art such as, for example, methods described in Examples 5, 9, or 12. For example, a polypeptide of the present invention, or combination of polypeptides of the present invention, protects a rodent such as a mouse against challenge with a *Staphylococcus* spp. A polypeptide of the present invention may have seroactive activity. "Seroactive activity" refers to the ability of a candidate polypeptide to react with antibody present in convalescent serum from an animal infected with a *Staphylococcus* spp., for instance, *S. aureus*. In some aspects, the convalescent serum may be from an animal infected with the ATCC isolate 19636, strain SAAV1, strain 2176, or strain 1477. Polypeptides of the present invention may have immunoregulatory activity. "Immunoregulatory activity" refers to the ability of a polypeptide to act in a nonspecific manner to enhance an immune response to a particular antigen. Methods for determining whether a polypeptide has immunoregulatory activity are known in the art.

A polypeptide of the present invention may have the characteristics of a polypeptide expressed by a reference microbe—i.e., a reference polypeptide. The characteristics can include, for example, molecular weight, mass fingerprint, amino acid sequence, or any combination thereof. The reference microbe can be a gram positive, preferably a member of the family Micrococcaceae, preferably, *Staphylococcus* spp., more preferably, *Staphylococcus aureus*. Preferred examples of strains are detailed in Table 1.

TABLE 1

Bacterial strains.

| Bacterial cell | Laboratory designation |
| --- | --- |
| S. aureus | ATCC isolate 19636 |
| S. aureus | strain SAAV1 |
| S. aureus | strain 1477 |
| S. aureus | strain 2176 |

When the reference microbe is *S. aureus* ATCC isolate 19636, a candidate polypeptide can be considered to be a polypeptide of the present invention if it has a molecular weight of 88 kDa, 55 kDa, 38 kDa, 37 kDa, 36 kDa 35 kDa, or 33 kDa, and has a mass fingerprint that is similar to the mass fingerprint of a metal-regulated polypeptide expressed by a reference microbe and having a molecular weight of 88 kDa, 55 kDa, 38 kDa, 37 kDa, 36 kDa 35 kDa, or 33 kDa, respectively. Preferably, such polypeptides are metal-regulated. For instance, a candidate polypeptide can be a polypeptide of the present invention if it has a molecular weight of 88 kDa and has a mass fingerprint similar to the mass fingerprint of an 88 kDa metal-regulated polypeptide produced by the reference strain *S. aureus* ATCC isolate 19636.

Alternatively, when the reference microbe is *S. aureus* ATCC isolate 19636, a candidate polypeptide can be considered to be a polypeptide of the present invention if it has an amino acid sequence that is structurally similar, as described in detail below, to the amino acid sequence of SEQ ID NO:353, SEQ ID NO:364, SEQ ID NO:375, SEQ ID NO:386, SEQ ID NO:397, SEQ ID NO:408, or SEQ ID NO:419.

Alternatively, when the reference microbe is *S. aureus* RF122, a candidate polypeptide can be considered to be a polypeptide of the present invention if it has an amino acid sequence that is structurally similar, as described in detail below, to the amino acid sequence of SEQ ID NO:354, SEQ ID NO:365, SEQ ID NO:376, SEQ ID NO:387, SEQ ID NO:398, SEQ ID NO:409, or SEQ ID NO:420.

Alternatively, when the reference microbe is *S. aureus* Mu50, a candidate polypeptide can be considered to be a polypeptide of the present invention if it has an amino acid sequence that is structurally similar, as described in detail below, to the amino acid sequence of SEQ ID NO:355, SEQ ID NO:366, SEQ ID NO:377, SEQ ID NO:388, SEQ ID NO:399, SEQ ID NO:410, or SEQ ID NO:421.

Alternatively, when the reference microbe is *S. aureus* MRSA252, a candidate polypeptide can be considered to be a polypeptide of the present invention if it has an amino acid sequence that is structurally similar, as described in detail below, to the amino acid sequence of SEQ ID NO:356, SEQ ID NO:367, SEQ ID NO:378, SEQ ID NO:389, SEQ ID NO:400, SEQ ID NO:411, or SEQ ID NO:422.

Alternatively, when the reference microbe is *S. aureus* MW2, a candidate polypeptide can be considered to be a polypeptide of the present invention if it has an amino acid sequence that is structurally similar, as described in detail below, to the amino acid sequence of SEQ ID NO:357, SEQ ID NO:368, SEQ ID NO:379, SEQ ID NO:390, SEQ ID NO:401, SEQ ID NO:412, or SEQ ID NO:423.

Alternatively, when the reference microbe is *S. aureus* Newman, a candidate polypeptide can be considered to be a polypeptide of the present invention if it has an amino acid sequence that is structurally similar, as described in detail below, to the amino acid sequence of SEQ ID NO:358, SEQ ID NO:369, SEQ ID NO:380, SEQ ID NO:391, SEQ ID NO:402, SEQ ID NO:413, or SEQ ID NO:424.

Alternatively, when the reference microbe is *S. aureus* JH9, a candidate polypeptide can be considered to be a polypeptide of the present invention if it has an amino acid sequence that is structurally similar, as described in detail below, to the amino acid sequence of SEQ ID NO:359, SEQ ID NO:370, SEQ ID NO:381, SEQ ID NO:392, SEQ ID NO:403, SEQ ID NO:414, or SEQ ID NO:425.

Alternatively, when the reference microbe is *S. aureus* USA300, a candidate polypeptide can be considered to be a polypeptide of the present invention if it has an amino acid sequence that is structurally similar, as described in detail below, to the amino acid sequence of SEQ ID NO:360, SEQ ID NO:371, SEQ ID NO:382, SEQ ID NO:393, SEQ ID NO:404, SEQ ID NO:415, or SEQ ID NO:426.

Alternatively, when the reference microbe is *S. aureus* COL, a candidate polypeptide can be considered to be a polypeptide of the present invention if it has an amino acid sequence that is structurally similar, as described in detail below, to the amino acid sequence of SEQ ID NO:361, SEQ ID NO:372, SEQ ID NO:383, SEQ ID NO:394, SEQ ID NO:405, SEQ ID NO:416, or SEQ ID NO:427.

Alternatively, when the reference microbe is *S. aureus* NCTC 8325, a candidate polypeptide can be considered to be a polypeptide of the present invention if it has an amino acid sequence that is structurally similar, as described in detail below, to the amino acid sequence of SEQ ID NO:362, SEQ ID NO:373, SEQ ID NO:384, SEQ ID NO:395, SEQ ID NO:406, SEQ ID NO:417, or SEQ ID NO:428.

Alternatively, when the reference microbe is *S. aureus* MSSA476, a candidate polypeptide can be considered to be a polypeptide of the present invention if it has an amino acid sequence that is structurally similar, as described in detail below, to the amino acid sequence of SEQ ID NO:363, SEQ ID NO:374, SEQ ID NO:385, SEQ ID NO:396, SEQ ID NO:407, SEQ ID NO:418, or SEQ ID NO:429.

When the reference microbe is *S. aureus* isolate SAAV1, a candidate polypeptide can be considered to be a polypeptide of the present invention if it has a molecular weight of 88 kDa, 55 kDa, 38 kDa, 37 kDa, 36 kDa, 35 kDa, or 33 kDa, and has a mass fingerprint that is similar to the mass fingerprint of a polypeptide expressed by a reference microbe and having a molecular weight of 88 kDa, 55 kDa, 38 kDa, 37 kDa, 36 kDa, 35 kDa, or 33 kDa, respectively. Preferably, such polypeptides are metal-regulated. For instance, a candidate polypeptide can be a polypeptide of the present invention if it has a molecular weight of 88 kDa and has a mass fingerprint similar to the mass fingerprint of an 88 kDa metal-regulated polypeptide produced by the reference strain S. aureus isolate SAAV1.

When the reference microbe is S. aureus strain 2176, a candidate polypeptide can be considered to be a polypeptide of the present invention if it has a molecular weight of 88 kDa, 80 kDa, 65 kDa, 55 kDa, 37 kDa, 36 kDa, 35 kDa, 33 kDa, or 32 kDa, and has a mass fingerprint that is similar to the mass fingerprint of a polypeptide expressed by a reference microbe and having a molecular weight of 88 kDa, 80 kDa, 65 kDa, 55 kDa, 37 kDa, 36 kDa, 35 kDa, 33 kDa, or 32 kDa, respectively. Preferably, such polypeptides are metal-regulated. For instance, a candidate polypeptide can be a polypeptide of the present invention if it has a molecular weight of 88 kDa and has a mass fingerprint similar to the mass fingerprint of an 88 kDa metal-regulated polypeptide produced by the reference strain S. aureus isolate 2176.

When the reference microbe is S. aureus strain 1477, a candidate polypeptide can be considered to be a polypeptide of the present invention if it has a molecular weight of 88 kDa, 80 kDa, 65 kDa, 55 kDa, 37 kDa, 36 kDa, 35 kDa, 33 kDa, or 32 kDa, and has a mass fingerprint that is similar to the mass fingerprint of a polypeptide expressed by a reference microbe and having a molecular weight of 88 kDa, 80 kDa, 65 kDa, 55 kDa, 37 kDa, 36 kDa, 35 kDa, 33 kDa, or 32 kDa, respectively. Preferably, such polypeptides are metal-regulated. For instance, a candidate polypeptide can be a polypeptide of the present invention if it has a molecular weight of 88 kDa and has a mass fingerprint similar to the mass fingerprint of an 88 kDa metal-regulated polypeptide produced by the reference strain S. aureus isolate 1477.

As used herein, a polypeptide may be "structurally similar" to a reference polypeptide if the amino acid sequence of the polypeptide possesses a specified amount of sequence similarity and/or sequence identity compared to the reference polypeptide. A polypeptide also may be "structurally similar" to a reference polypeptide if the polypeptide exhibits a mass fingerprint possessing a specified amount of identity compared to a comparable mass fingerprint of the reference polypeptide. Thus, a polypeptide may be "structurally similar" to a reference polypeptide if, compared to the reference polypeptide, it possesses a sufficient level of amino acid sequence identity, amino acid sequence similarity, mass fingerprint similarity, or any combination thereof.

Polypeptide Sequence Similarity and Polypeptide Sequence Identity

Structural similarity of two polypeptides can be determined by aligning the residues of the two polypeptides (for example, a candidate polypeptide and any appropriate reference polypeptide described herein) to optimize the number of identical amino acids along the lengths of their sequences; gaps in either or both sequences are permitted in making the alignment in order to optimize the number of identical amino acids, although the amino acids in each sequence must nonetheless remain in their proper order. A reference polypeptide may be a polypeptide described herein or any known metal-regulated polypeptide, as appropriate. A candidate polypeptide is the polypeptide being compared to the reference polypeptide. A candidate polypeptide can be isolated, for example, from a microbe, or can be produced using recombinant techniques, or chemically or enzymatically synthesized.

Unless modified as otherwise described herein, a pairwise comparison analysis of amino acid sequences can be carried out using the BESTFIT algorithm in the GCG package (version 10.2, Madison Wis.). Alternatively, polypeptides may be compared using the Blastp program of the BLAST 2 search algorithm, as described by Tatiana et al., (FEMS Microbiol Lett, 174, 247-250 (1999)), and available on the National Center for Biotechnology Information (NCBI) website. The default values for all BLAST 2 search parameters may be used, including matrix=BLOSUM62; open gap penalty=11, extension gap penalty=1, gap x_dropoff=50, expect=10, wordsize=3, and filter on.

In the comparison of two amino acid sequences, structural similarity may be referred to by percent "identity" or may be referred to by percent "similarity." "Identity" refers to the presence of identical amino acids. "Similarity" refers to the presence of not only identical amino acids but also the presence of conservative substitutions. A conservative substitution for an amino acid in a polypeptide of the invention may be selected from other members of the class to which the amino acid belongs. For example, it is well-known in the art of protein biochemistry that an amino acid belonging to a grouping of amino acids having a particular size or characteristic (such as charge, hydrophobicity and hydrophilicity) can be substituted for another amino acid without altering the activity of a protein, particularly in regions of the protein that are not directly associated with biological activity. For example, nonpolar (hydrophobic) amino acids include alanine, leucine, isoleucine, valine, proline, phenylalanine, tryptophan, and tyrosine. Polar neutral amino acids include glycine, serine, threonine, cysteine, tyrosine, asparagine and glutamine. The positively charged (basic) amino acids include arginine, lysine and histidine. The negatively charged (acidic) amino acids include aspartic acid and glutamic acid. Conservative substitutions include, for example, Lys for Arg and vice versa to maintain a positive charge; Glu for Asp and vice versa to maintain a negative charge; Ser for Thr so that a free —OH is maintained; and Gln for Asn to maintain a free —NH2. Likewise, biologically active analogs of a polypeptide containing deletions or additions of one or more contiguous or noncontiguous amino acids that do not eliminate a functional activity—such as, for example, immunological activity—of the polypeptide are also contemplated.

Thus, as used herein, reference to a polypeptide of the present invention and/or reference to the amino acid sequence of one or more SEQ ID NOs can include a polypeptide with at least 50%, at least 55%, at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence similarity to the reference amino acid sequence.

Alternatively, as used herein, reference to a polypeptide of the present invention and/or reference to the amino acid sequence of one or more SEQ ID NOs can include a polypeptide with at least 50%, at least 55%, at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to the reference amino acid sequence.

Consequently, a polypeptide of the present invention can include certain variants including, for example, homologous polypeptides that originate—biologically and/or recombinantly—from microbial species or strains other than the microbial species or strain from which the polypeptide was originally isolated and/or identified.

For example, a polypeptide of the invention can include a polypeptide commonly known as formate acetyltransferase (PflB). One embodiment of this polypeptide is reflected in SEQ ID NO:353. Variant embodiments are reflected in SEQ ID NO:354, SEQ ID NO:355, SEQ ID NO:356, SEQ ID NO:357, SEQ ID NO:358, SEQ ID NO:359, SEQ ID NO:360, SEQ ID NO:361, SEQ ID NO:362, and SEQ ID NO:363.

As another example, a polypeptide of the invention can include a polypeptide commonly known as oligopeptide permease, peptide-binding protein (Opp1A). One embodiment of this polypeptide is reflected in SEQ ID NO:364. Variant embodiments are reflected in SEQ ID NO:365, SEQ ID NO:366, SEQ ID NO:367, SEQ ID NO:368, SEQ ID NO:369, SEQ ID NO:370, SEQ ID NO:371, SEQ ID NO:372, SEQ ID NO:373, and SEQ ID NO:374.

As another example, a polypeptide of the invention can include a polypeptide commonly known as siderophore compound ABC transporter binding protein (SirA). One embodiment of this polypeptide is reflected in SEQ ID NO:375. Variant embodiments are reflected in SEQ ID NO:376, SEQ ID NO:377, SEQ ID NO:378, SEQ ID NO:379, SEQ ID NO:380, SEQ ID NO:381, SEQ ID NO:382, SEQ ID NO:383, SEQ ID NO:384, and SEQ ID NO:385.

As another example, a polypeptide of the invention can include a polypeptide sometimes referred to herein as SYN2. One embodiment of this polypeptide is reflected in SEQ ID NO:386. Variant embodiments are reflected in SEQ ID NO:387, SEQ ID NO:388, SEQ ID NO:389, SEQ ID NO:390, SEQ ID NO:391, SEQ ID NO:392, SEQ ID NO:393, SEQ ID NO:394, SEQ ID NO:395, and SEQ ID NO:396.

As another example, a polypeptide of the invention can include a polypeptide commonly known as ferric hydroxamate-binding lipoprotein (FhuD). One embodiment of this polypeptide is reflected in SEQ ID NO:397. Variant embodiments are reflected in SEQ ID NO:398, SEQ ID NO:399, SEQ ID NO:400, SEQ ID NO:401, SEQ ID NO:402, SEQ ID NO:403, SEQ ID NO:404, SEQ ID NO:405, SEQ ID NO:406, and SEQ ID NO:407.

As another example, a polypeptide of the invention can include a polypeptide sometimes referred to herein as SYN1. One embodiment of this polypeptide is reflected in SEQ ID NO:408. Variant embodiments are reflected in SEQ ID NO:409, SEQ ID NO:410, SEQ ID NO:411, SEQ ID NO:412, SEQ ID NO:413, SEQ ID NO:414, SEQ ID NO:415, SEQ ID NO:416, SEQ ID NO:417, and SEQ ID NO:418.

As another example, a polypeptide of the invention can include a polypeptide commonly known as manganese transport system membrane protein (MntC). One embodiment of this polypeptide is reflected in SEQ ID NO:419. Variant embodiments are reflected in SEQ ID NO:420, SEQ ID NO:421, SEQ ID NO:422, SEQ ID NO:423, SEQ ID NO:424, SEQ ID NO:425, SEQ ID NO:426, SEQ ID NO:427, SEQ ID NO:428, and SEQ ID NO:429.

As another example, a polypeptide of the invention can include a polypeptide commonly known as ferrichrome ABC transporter lipoprotein (SstD). Embodiments of this polypeptide are reflected in SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, and SEQ ID NO:552.

As another example, a polypeptide of the invention can include a polypeptide commonly known as iron compound ABC transporter (FhuD2). Embodiments of this polypeptide are reflected in SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, and SEQ ID NO:562.

A polypeptide of the present invention also can be designed to provide one or more additional sequences such as, for example, the addition of coding sequences for added C-terminal and/or N-terminal amino acids that may facilitate purification by trapping on columns or use of antibodies. Such tags include, for example, histidine-rich tags that allow purification of polypeptides on nickel columns. Such gene modification techniques and suitable additional sequences are well known in the molecular biology arts.

A polypeptide of the present invention also may be designed so that certain amino acids at the C-terminal and/or N-terminal are deleted. For example, one difference between the amino acid sequences of SEQ ID NO:364 and SEQ ID NO:365 is that SEQ ID NO:365 possesses an N-terminal 29 amino acid addition that is not present in the amino acid sequence of the reference polypeptide of SEQ ID NO:364. Similar exemplary N-terminal additions, typically varying from about 20 amino acids to about 35 amino acids, are apparent when one compares, for example, the amino acid sequence of reference peptide SEQ ID NO:353, SEQ ID NO:364, SEQ ID NO:375, SEQ ID NO:386, SEQ ID NO:397, SEQ ID NO:408, or SEQ ID NO:419 with certain variant embodiments of the respective reference polypeptide. Other amino acids additions and/or deletions, at either the N-terminal or the C-terminal, are possible.

A "modification" of a polypeptide of the present invention includes polypeptides (or analogs thereof such as, e.g., fragments thereof) that are chemically or enzymatically derivatized at one or more constituent amino acid. Such modifications can include, for example, side chain modifications, backbone modifications, and N- and C-terminal modifications such as, for example, acetylation, hydroxylation, methylation, amidation, and the attachment of carbohydrate or lipid moieties, cofactors, and the like, and combinations thereof. Modified polypeptides of the invention may retain the biological activity—such as, for example, immunological activity—of the unmodified polypeptide or may exhibit a reduced or increased biological activity.

The polypeptides of the present invention (including biologically active analogs thereof and modifications thereof) include native (naturally occurring), recombinant, and chemically or enzymatically synthesized polypeptides. For example, a polypeptide of the present invention may be prepared by isolating the polypeptide from a natural source or may be prepared recombinantly by well known methods including, for example, preparation as fusion proteins in bacteria or other host cells.

The polypeptides expressed by a reference microbe can be obtained by growth of the reference microbe under low metal conditions and the subsequent isolation of a polypeptide by the processes disclosed herein. Alternatively, polypeptides expressed by a reference microbe can be obtained by identifying genes expressed at higher levels when the microbe is grown in low metal conditions—i.e., metal-regulated genes. The metal-regulated genes can be cloned and expressed, and the expressed metal-regulated polypeptides may be identified by the processes described herein. A candidate polypeptide can be isolatable from a microbe or identified from a microbe, preferably a gram positive microbe, more preferably a member of the family Micrococcaceae, preferably, *Staphylococcus* spp., more preferably, *Staphylococcus aureus*.

Other gram positive microbes from which polypeptides can be isolated and/or identified include *Corynebacterium* spp., *Enterococcus* spp., *Erysipelothrix* spp., *Kytococcus* spp., and *Micrococcus* spp., *Mycobacterium* spp., and *Erysipelothrix* spp. A candidate polypeptide may also be produced using enzymatic or chemical techniques.

Mass Fingerprint Similarity

A candidate polypeptide may be evaluated by mass spectrometric analysis to determine whether the candidate polypeptide has a mass fingerprint similar to one of the polypeptides expressed by a reference microbe and referred to above by molecular weight. Typically, the candidate polypeptide can be isolated, for instance by resolving the candidate polypeptide by gel electrophoresis and excising the portion of the gel containing the candidate polypeptide. Any gel electrophoresis method that separates polypeptides based on differing characteristics can be used, including 1 dimensional or 2 dimensional gel electrophoresis, as well as liquid chromatographic separation based on, for instance, hydrophobicity, pI, or size. The candidate polypeptide can be fragmented, for instance by digestion with a protease. Preferably, the protease can cleave the peptide bond on the carboxy-terminal side of the amino acid lysine and the amino acid arginine, except when the amino acid following the lysine or the arginine is a proline. An example of such a protease is trypsin. Methods for digesting a polypeptide with trypsin are routine and known in the art. An example of such a method is disclosed in Example 13.

Methods for the mass spectrometric analysis of polypeptides are routine and known in the art and include, but are not limited to, matrix assisted laser desorption/ionization time of flight mass spectroscopy (MALDI-TOF MS). Typically, a mixture containing the polypeptide fragments obtained from a candidate polypeptide is mixed with a matrix that functions to transform the laser energy to the sample and produce ionized, preferably monoisotopic, polypeptide fragments. Examples of matrices that can be used include, for instance, sinapinic acid or cyano-4-hydroxycinnamic acid. An example of a method for the analysis of polypeptides by MALDI-TOF MS is described in Example 13. The ionized polypeptide fragments are separated according to their m/z ratio, and detected to yield a spectrum of m/z ratio versus intensity. The spectrum includes m/z values that represent the polypeptide fragments derived from the candidate polypeptide. For any given polypeptide, the amount of each polypeptide fragment resulting from a trypsin digestion should be equimolar. However, it is known that trypsin digestion is not always 100% efficient, for instance, some sites are more efficiently cleaved. Thus, when MALDI-TOF MS is used to determine m/z values, the intensity of each m/z value is typically not identical. Generally, a spectrum has a background level of noise present across most of the x-axis (i.e., the axis having the values of the m/z ratios). This background level of noise varies depending on the running conditions and the machine used, and is easily identified by visual inspection of the spectrum An m/z value is generally considered to represent a polypeptide fragment when the intensity is at least 2 times greater, at least 3 times greater, or at least 4 times greater than the background level of noise. The spectrum usually includes other m/z values that are artifacts resulting from, for instance, incomplete digestion, over digestion, other polypeptides that may be present in the mixture, or the protease used to digest the polypeptide including m/z values resulting from autolysis of the protease. This method of digesting a polypeptide with a protease is recognized in the art as resulting in a mass fingerprint of great specificity that can be used to accurately characterize the polypeptide and distinguish it from other polypeptides.

In this aspect of the invention, when a candidate polypeptide is analyzed by mass spectroscopy, preferably both the candidate polypeptide and the polypeptide from the reference microbe are prepared and analyzed together, thereby decreasing any potential artifacts resulting from differences in sample handling and running conditions. Preferably, all reagents used to prepare and analyze the two polypeptides are the same. For instance, the polypeptide from the reference microbe and the candidate polypeptide are isolated under substantially the same conditions, fragmented under substantially the same conditions, and analyzed by MALDI-TOF MS on the same machine under substantially the same conditions. A candidate polypeptide may be considered to be "structurally similar" to a reference polypeptide if it exhibits a mass fingerprint possessing at least 80%, at least 90%, at least 95%, or substantially all of the m/z values present in the spectrum of the reference microbe polypeptide and above the background level of noise are also present in the spectrum of the candidate polypeptide. (See, e.g., United States Patent Application Publication No. 2006/0233824 A1).

In another aspect, a polypeptide can be considered to be a polypeptide of the present invention if it has a molecular weight of a reference polypeptide described in Table 2, 3, 4, or 5 and has a mass fingerprint that includes a subpopulation including at least a specified percentage of the polypeptide fragments of the reference polypeptide as listed in Table 2, 3, 4, or 5. For instance, a polypeptide of the present invention includes a polypeptide of 88 kDa and a mass fingerprint that includes a specified percentage of polypeptide fragments having masses of HVDVR (SEQ ID NO: 1), YSYER (SEQ ID NO: 2), IIGDYRR (SEQ ID NO: 3), IFTDYRK (SEQ ID NO: 4), ELKELGQK (SEQ ID NO: 5), YAQVKPIR (SEQ ID NO: 6), QMQFFGAR (SEQ ID NO: 7), SMQPFGGIR (SEQ ID NO: 8), VSGYAVNFIK (SEQ ID NO: 9), NHATAWQGFK (SEQ ID NO: 10), LWEQVMQLSK (SEQ ID NO: 11), SLGKEPEDQNR (SEQ ID NO: 12), DGISNTFSIVPK (SEQ ID NO: 13), AGVITGLPDAYGR (SEQ ID NO: 14), TSTFLDIYAER (SEQ ID NO: 15), SMQPFGGIRMAK (SEQ ID NO: 16), THNQGVFDAYSR (SEQ ID NO: 17), KAGVITGLPDAYGR (SEQ ID NO: 18), TLLYAINGGKDEK (SEQ ID NO: 19), IEMALHDTEIVR (SEQ ID NO: 20), AGEPFAPGANPMHGR (SEQ ID NO: 21), VALYGVDFLMEEK (SEQ ID NO: 22), KTHNQGVFDAYSR (SEQ ID NO: 23), YGFDLSRPAENFK (SEQ ID NO: 24), TSSIQYENDDIMR (SEQ ID NO: 25), KAGEPFAPGANPMHGR (SEQ ID NO: 26), RVALYGVDFLMEEK (SEQ ID NO: 27), LWEQVMQLSKEER (SEQ ID NO: 28), MLETNKNHATAWQGFK (SEQ ID NO: 29), MHDFNTMSTEMSEDVIR (SEQ ID NO: 30), YGNNDDRVDDIAVDLVER (SEQ ID NO: 31), ETLIDAMEHPEEYPQLTIR (SEQ ID NO: 32), YAQVKPIRNEEGLVVDFEIEGDFPK (SEQ ID NO: 33).

The mass fingerprint of a candidate polypeptide can be determined by a mass spectrometric method, for instance by MALDI-TOF MS. The mass fingerprint of a candidate polypeptide will generally have additional polypeptide fragments and, therefore, can have additional m/z values other than those listed for a polypeptide in Table 2, 3, 4, or 5. When the candidate polypeptide is being compared to a polypeptide in Table 2, 3, 4, or 5, the candidate polypeptide can be isolatable from a microbe, preferably a gram positive microbe, more preferably, a member of the family Micrococcaceae, preferably, *Staphylococcus* spp., more preferably, *Staphylococcus aureus*. Other gram positive microbes include *Corynebacterium* spp., *Enterococcus* spp., *Erysipelothrix* spp., *Kytococcus* spp., *Listeria* spp., *Micrococcus* spp., and *Mycobacterium* spp., and *Erysipelothrix* spp.

A candidate polypeptide can be obtained by growth of a microbe under low metal conditions and the subsequent isolation of a polypeptide by the processes described herein. Alternatively, a candidate polypeptide can be obtained by recombinant expression of a polynucleotide that encodes the candidate polypeptide.

It is well known in the art that modifications of amino acids can be accidentally introduced during sample handling, such as oxidation, and formation of carbamidomethyl derivatives. Further, these types of modifications alter the m/z value of a polypeptide fragment. For instance, if a polypeptide fragment contains a methionine that is oxidized, the m/z value will be increased by 16 relative to the same fragment that does not contain the oxidized methionine. Accordingly, those polypeptide fragments in Tables 2, 3, 4, or 5 having the notation "oxidation (M)" have an m/z value that is increased by 16 relative to the same fragment that does not contain the oxidized methionine. It is understood that the polypeptide fragments of Table 2, 3, 4, or 5 can be modified during sample handling.

Polynucleotide Sequence Similarity and Polynucleotide Sequence Identity

Polypeptides of the invention also may be identified in terms the polynucleotide that encodes the polypeptide. Thus, the invention includes polynucleotides that encode a polypeptide of the invention or hybridize, under standard hybridization conditions, to a polynucleotide that encodes a polypeptide of the invention, and the complements of such polynucleotide sequences.

As used herein, reference to a polynucleotide of the present invention and/or reference to the nucleic acid sequence of one or more SEQ ID NOs can include polynucleotides having a sequence identity of at least 50%, at least 55%, at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% sequence identity to an identified reference polynucleotide sequence.

TABLE 2

Characteristics of polypeptides obtained from *S. aureus* ATCC isolate 19636.

| Polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| P23 | 88 | 625.4 | HVDVR | 1 |
| | | 717.3 | YSYER | 2 |
| | | 892.5 | IIGDYRR | 3 |
| | | 942.5 | IFTDYRK | 4 |
| | | 944.5 | ELKELGQK | 5 |
| | | 974.6 | YAQVKPIR | 6 |
| | | 984.5 | QMQFFGAR | 7 |
| | | 992.5 | SMQPFGGIR | 8 |
| | | 1097.6 | VSGYAVNFIK | 9 |
| | | 1159.5 | NHATAWQGFK | 10 |
| | | 1261.7 | LWEQVMQLSK | 11 |
| | | 1272.7 | SLGKEPEDQNR | 12 |
| | | 1277.7 | DGISNTFSIVPK | 13 |
| | | 1289.7 | AGVITGLPDAYGR | 14 |
| | | 1315.7 | TSTFLDIYAER | 15 |
| | | 1322.7 | SMQPFGGIRMAK | 16 |
| | | 1394.7 | THNQGVFDAYSR | 17 |
| | | 1417.8 | KAGVITGLPDAYGR | 18 |
| | | 1421.8 | TLLYAINGGKDEK | 19 |
| | | 1426.8 | IEMALHDTEIVR | 20 |
| | | 1508.8 | AGEPFAPGANPMHGR | 21 |
| | | 1513.9 | VALYGVDFLMEEK | 22 |

TABLE 2-continued

Characteristics of polypeptides obtained from *S. aureus* ATCC isolate 19636.

| Polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| | | 1522.8 | KTHNQGVFDAYSR | 23 |
| | | 1543.9 | YGFDLSRPAENFK | 24 |
| | | 1571.8 | TSSIQYENDDIMR | 25 |
| | | 1636.9 | KAGEPFAPGANPMHGR | 26 |
| | | 1670.0 | RVALYGVDFLMEEK | 27 |
| | | 1676.0 | LWEQVMQLSKEER | 28 |
| | | 1876.2 | MLETNKNHATAWQGFK | 29 |
| | | 2043.1 | MHDFNTMSTEMSEDVIR | 30 |
| | | 2078.2 | YGNNDDRVDDIAVDLVER | 31 |
| | | 2285.5 | ETLIDAMEHPEEYPQLTIR | 32 |
| | | 2892.9 | YAQVKPIRNEEGLVVDFEIEGDFPK | 33 |
| P25 | 55 | 783.6 | LHSWLK | 34 |
| | | 911.7 | KLHSWLK | 35 |
| | | 937.6 | TYTFHLR | 36 |
| | | 996.6 | KFDGTGPFK | 37 |
| | | 1025.6 | QAIGHMVNR | 38 |
| | | 1063.6 | KWDVSEDGK | 39 |
| | | 1185.6 | IYNSIDDAFK | 40 |
| | | 1277.6 | NLEMAMYYDK | 41 |
| | | 1324.7 | ENKQLTYTTVK | 42 |
| | | 1346.7 | AESLLDEAGWKK | 43 |
| | | 1381.8 | TVRQAIGHMVNR | 44 |
| | | 1394.8 | TYTFHLRDDVK | 45 |
| | | 1400.7 | KGETNFAFTDDR | 46 |
| | | 1419.7 | FHDGTPFDADAVK | 47 |
| | | 1422.8 | NVTDINFDMPTR | 48 |
| | | 1428.8 | DKIYNSIDDAFK | 49 |
| | | 1483.8 | EQAEYLQAEFKK | 50 |
| | | 1509.8 | VMPAGETAFISMKK | 51 |
| | | 1547.9 | FHDGTPFDADAVKK | 52 |
| | | 1550.9 | NVTDINFDMPTRK | 53 |
| | | 1559.9 | LNINGETSDKIAER | 54 |
| | | 1788.1 | EILDGQEKPATQLFAK | 55 |
| | | 1930.1 | GSSSQKEQAEYLQAEFK | 56 |
| | | 1946.0 | DESADFNKNDQYWGEK | 57 |
| | | 2100.4 | IAKEILDGQEKPATQLFAK | 58 |

TABLE 2-continued

Characteristics of polypeptides obtained from *S. aureus* ATCC isolate 19636.

| Polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| | | 2239.3 | VSFTQSQYELPFNEMQYK | 59 |
| | | 2493.5 | EAYQPALAELAMPRPYVFVSPK + Oxidation (M) | 60 |
| | | 2900.6 | DIGDMNPHVYGGSMSAESMIYEPLVR + 2 Oxidation (M) | 61 |
| | | 2916.6 | DIGDMNPHVYGGSMSAESMLYEPLVR + 3 Oxidation (M) | 62 |
| P26 | 38 | 993.6 | IVYVGADEK | 63 |
| | | 996.7 | QALNNPVLK | 64 |
| | | 1237.7 | ETVKIENNYK | 65 |
| | | 1272.7 | ENPDVILAMDR | 66 |
| | | 1502.0 | IAATKPEVIFISGR | 67 |
| | | 1507.9 | NAVVLDYGALDVMK | 68 |
| | | 1523.9 | ALPNFLESFKDDK | 69 |
| | | 1559.9 | LWYFAAGSTTTTIK | 70 |
| | | 1716.0 | FGGLVYDTLGFNAVDK | 71 |
| | | 1737.0 | IVYVGADEKNLIGSMK | 72 |
| | | 1844.1 | FGGLVYDTLGFNAVDKK | 73 |
| | | 1929.1 | GRFGGLVYDTLGFNAVDK | 74 |
| | | 1998.2 | TVMYLLVNEGELSTFGPK | 75 |
| | | 2234.4 | EVNFDKIAATKPEVIFISGR | 76 |
| | | 3143.8 | VSNSNHGQNVSNEYVNKENPDVILAMDR | 77 |
| P27 | 37 | 699.5 | FEYIK | 78 |
| | | 729.4 | DAWPLK | 79 |
| | | 792.5 | ASVVNFR | 80 |
| | | 852.4 | VYDQLSK | 81 |
| | | 987.5 | HAMGTTEIK | 82 |
| | | 1008.5 | LIDDLYEK | 83 |
| | | 1020.5 | YKDAWPLK | 84 |
| | | 1074.5 | EKEAEDLLK | 85 |
| | | 1083.6 | LKPDLIVASK | 86 |
| | | 1169.5 | FEYIKNDLK | 87 |
| | | 1182.5 | KTESEWTSSK | 88 |
| | | 1184.5 | YDDKVAAFQK | 89 |
| | | 1223.5 | NEKVYDQLSK | 90 |
| | | 1278.6 | IAPTVSTDTVFK | 91 |
| | | 1497.6 | TESEWTSSKEWK | 92 |
| | | 1502.7 | DAWPLKASVVNFR | 93 |

TABLE 2-continued

Characteristics of polypeptides obtained from S. aureus ATCC isolate 19636.

| Polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| | | 1558.8 | QVDNGKDIIQLTSK | 94 |
| | | 1605.8 | LIDDLYEKLNIEK | 95 |
| | | 1623.8 | IVGQEPAPNLEEISK | 96 |
| | | 1712.8 | ESIPLMNADHIFVVK | 97 |
| | | 1800.9 | IYAGGYAGEILNDLGFK | 98 |
| | | 1957.0 | IYAGGYAGEILNDLGFKR | 99 |
| | | 2252.0 | NNQVSDDLDEITWNLAGGYK | 100 |
| | | 3383.9 | RVVTLYQGATDVAVSLGVKPVGAVESWTQKPK | 101 |
| P28 | 36 | 646.4 | DVWAR | 102 |
| | | 725.5 | IIKPVR | 103 |
| | | 1068.4 | IGDYTSVGTR | 104 |
| | | 1185.5 | KQPNLEEISK | 105 |
| | | 1327.6 | LKPDLIIADSSR | 106 |
| | | 1343.6 | VDIVDRDVWAR | 107 |
| | | 2080.9 | GPYLQLDTEHLADLNPER | 108 |
| | | 2438.1 | AGLLAHPNYSYVGQFLNELGFK | 109 |
| | | 2789.4 | IVVLEYSFADALAALDVKPVGIADDGK | 110 |
| P29 | 35 | 760.5 | AGWAEVK | 111 |
| | | 1012.6 | TVDIPKDPK | 112 |
| | | 1107.6 | KDWEETTAK | 113 |
| | | 1204.7 | VAPTVVVDYNK | 114 |
| | | 1238.6 | YLEQQEMLGK | 115 |
| | | 1244.6 | LYTYGDNWGR | 116 |
| | | 1259.7 | IAVVAPTYAGGLK | 117 |
| | | 1281.7 | GGEVLYQAFGLK | 118 |
| | | 1516.8 | AGWAEVKQEEIEK | 119 |
| | | 1683.9 | LGANIVAVNQQVDQSK | 120 |
| | | 1877.1 | EKPDLIIVYSTDKDIK | 121 |
| | | 1884.0 | AIGQDATVSLFDEFDKK | 122 |
| | | 2227.1 | VDAGTYWYNDPYTLDFMR | 123 |
| | | 2781.4 | YAGDYIVSTSEGKPTPGYESTNMWK | 124 |
| P30 | 33 | 834.5 | QAIEFVK | 125 |
| | | 864.5 | YIAQLEK | 126 |
| | | 946.5 | QGTPEQMR | 127 |
| | | 962.5 | QAIEFVKK | 128 |
| | | 976.5 | DKENDIPK | 129 |

TABLE 2-continued

Characteristics of polypeptides obtained from S. aureus ATCC isolate 19636.

| Polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| | | 1054.5 | AMITSEGAFK | 130 |
| | | 1202.5 | SNIETVHGSMK | 131 |
| | | 1268.6 | HLLVETSVDKK | 132 |
| | | 1443.6 | DIFGEVYTDSIGK | 133 |
| | | 1450.7 | TIQQTFIDNDKK | 134 |
| | | 1454.7 | VVTTNSILYDMAK | 135 |
| | | 1571.7 | KDIFGEVYTDSIGK | 136 |
| | | 1593.7 | QDPHAWLSLDNGIK | 137 |
| | | 1818.9 | DVKPIYLNGEEGNKDK | 138 |
| | | 1836.9 | DKQDPHAWLSLDNGIK | 139 |
| | | 1911.9 | QYGITPGYIWEINTEK | 140 |
| | | 2582.3 | LTDADVILYNGLNLETGNGWFEK | 141 |
| | | 2710.2 | KLTDADVILYNGLNLETGNGWFEK | 142 |
| | | 2942.4 | NVGGDNVDIHSIVPVGQDPHEYEVKPK | 143 |

[1]Molecular weight as determined by SDS-PAGE.
[2]The m/z value of a polypeptide fragment can be converted to mass by subtracting 1 from the m/z value. Each mass includes a range of plus or minus 300 parts per million (ppm), or plus or minus 1 Da.

TABLE 3

Characteristics of polypeptides obtained from S. aureus isolate SAAV1.

| polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| P33A | 55 | 783.4 | LHSWLK | 144 |
| | | 911.5 | KLHSWLK | 145 |
| | | 937.5 | TYTFHLR | 146 |
| | | 996.5 | KFDGTGPFK | 147 |
| | | 1025.5 | QAIGHMVNR | 148 |
| | | 1039.4 | NDQYWGEK | 149 |
| | | 1178.5 | GTDSLDKDSLK | 150 |
| | | 1185.5 | IYNSIDDAFK | 151 |
| | | 1222.6 | DKYTVELNLK | 152 |
| | | 1229.5 | ISTLIDNVKVK | 153 |
| | | 1346.6 | AESLLDEAGWKK | 154 |
| | | 1355.5 | EQAEYLQAEFK | 155 |
| | | 1381.6 | VMPAGETAFLSMK | 156 |
| | | 1400.5 | KGETNFAFTDDR | 157 |
| | | 1419.6 | FHDGTPFDADAVK | 158 |

TABLE 3-continued

Characteristics of polypeptides obtained from *S. aureus* isolate SAAV1.

| polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| | | 1422.6 | NVTDINFDMPTR | 159 |
| | | 1483.6 | EQAEYLQAEFKK | 160 |
| | | 1547.7 | FHDGTPFDADAVKK | 161 |
| | | 1550.6 | NVTDINFDMPTRK | 162 |
| | | 1559.7 | LNINGETSDKIAER | 163 |
| | | 1787.9 | EILDGQEKPATQLFAK | 164 |
| | | 1945.8 | DESADFNKNDQYWGEK | 165 |
| | | 2239.0 | VSFTQSQYELPFNEMQYK | 166 |
| | | 2354.1 | QIDDEGEIFIPISHGSMTVVAPK | 167 |
| | | 2868.1 | DIGDMNPHVYGGSMSAESMIYEPLVR | 168 |
| P33B | 55 | 895.4 | FPYAANGR | 169 |
| | | 904.5 | ALLHASHR | 170 |
| | | 1045.5 | EEGLAIKASK | 171 |
| | | 1384.5 | GEAYFVDNNSLR | 172 |
| | | 1435.7 | TIEADYVLVTVGR | 173 |
| | | 1669.8 | RPNTDELGLEELGVK | 174 |
| | | 1841.0 | NAIIATGSRPIEIPNFK | 175 |
| | | 2179.2 | TSISNIYAIGDIVPGLPLAHK | 176 |
| | | 2546.2 | FVEAQHSENLGVIAESVSLNFQK | 177 |
| | | 2587.3 | VVGDFPIETDTIVIGAGPGGYVAAIR | 178 |
| P35 | 37 | 699.4 | FEYIK | 179 |
| | | 729.4 | DAWPLK | 180 |
| | | 792.4 | ASVVNFR | 181 |
| | | 852.4 | VYDQLSK | 182 |
| | | 1008.4 | LIDDLYEK | 183 |
| | | 1020.4 | YKDAWPLK | 184 |
| | | 1074.4 | EKEAEDLLK | 185 |
| | | 1083.5 | LKPDLIVASK | 186 |
| | | 1169.5 | FEYIKNDLK | 187 |
| | | 1182.4 | KTESEWTSSK | 188 |
| | | 1184.4 | YDDKVAAFQK | 189 |
| | | 1278.5 | IAPTVSTDTVFK | 190 |
| | | 1558.7 | QVDNGKDIIQLTSK | 191 |
| | | 1623.7 | IVGQEPAPNLEEISK | 192 |
| | | 1712.7 | ESIPLMNADHIFVVK | 193 |
| | | 1800.7 | IYAGGYAGEILNDLGFK | 194 |

TABLE 3-continued

Characteristics of polypeptides obtained from *S. aureus* isolate SAAV1.

| polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| | | 1956.8 | IYAGGYAGEILNDLGFKR | 195 |
| | | 2251.9 | NNQVSDDLDEITWNLAGGYK | 196 |
| | | 3227.5 | VVTLYQGATDVAVSLGVKPVGAVESWTQKPK | 197 |
| P38 | 33 | 864.5 | YIAQLEK | 198 |
| | | 946.4 | QGTPEQMR | 199 |
| | | 976.5 | DKFNDIPK | 200 |
| | | 1054.5 | AMITSEGAFK | 201 |
| | | 1146.5 | FNDIPKEQR | 202 |
| | | 1268.6 | HLLVETSVDKK | 203 |
| | | 1322.5 | TIQQTFIDNDK | 204 |
| | | 1443.6 | DIFGEVYTDSIGK | 205 |
| | | 1450.6 | TIQQTFIDNDKK | 206 |
| | | 1454.6 | VVTTNSILYDMAK | 207 |
| | | 1593.7 | QDPHAWLSLDNGIK | 208 |
| | | 1818.9 | DVKPIYLNGEEGNKDK | 209 |
| | | 1836.8 | DKQDPHAWLSLDNGIK | 210 |
| | | 1911.9 | QYGITPGYIWEINTEK | 211 |
| | | 2942.4 | NVGGDNVDIHSIVPVGQDPHEYEVKPK | 212 |

[1]Molecular weight as determined by SDS-PAGE.
[2]The m/z value of a polypeptide fragment can be converted to mass by subtracting 1 from the m/z value. Each mass includes a range of plus or minus 300 parts per million (ppm) or plus or minus 1 Da.

TABLE 4

Characteristics of polypeptides obtained from *S. aureus* isolate 2176.

| Polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| P478 | 88 | 736.35 | IIGDYR | 213 |
| | | 814.49 | IFTDYR | 214 |
| | | 942.42 | IFTDYRK | 4 |
| | | 945.36 | TGNTPDGRK | 215 |
| | | 974.40 | YAQVKPIR | 6 |
| | | 984.27 | QMQFFGAR | 7 |
| | | 992.41 | SMQPFGGIR | 8 |
| | | 1087.31 | EQQLDVISR | 216 |
| | | 1097.31 | VSGYAVNFIK | 9 |
| | | 1159.37 | NHATAWQGFK | 10 |
| | | 1261.37 | LWEQVMQLSK | 11 |

TABLE 4-continued

Characteristics of polypeptides obtained from *S. aureus* isolate 2176.

| Polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| | | 1289.46 | AGVITGLPDAYGR | 14 |
| | | 1315.42 | TSTFLDIYAER | 15 |
| | | 1322.39 | LREELSEQYR | 217 |
| | | 1394.37 | THNQGVFDAYSR | 17 |
| | | 1417.52 | KAGVITGLPDAYGR | 18 |
| | | 1426.36 | IEMALHDTEIVR | 20 |
| | | 1487.39 | NHATAWQGFKNGR | 218 |
| | | 1508.42 | AGEPFAPGANPMHGR | 21 |
| | | 1513.52 | VALYGVDFLMEEK | 22 |
| | | 1543.43 | YGFDLSRPAENFK | 24 |
| | | 1571.50 | TSSIQYENDDIMR | 25 |
| | | 1636.56 | KAGEPFAPGANPMHGR | 26 |
| | | 1859.80 | DLETIVGVQTEKPFKR | 219 |
| | | 1876.77 | TMATGIAGLSVAADSLSAIK | 220 |
| | | 2042.57 | MHDFNTMSTEMSEDVIR | 30 |
| | | 2077.68 | YGNNDDRVDDIAVDLVER | 31 |
| | | 2158.88 | AGVITESEVQEIIDHFIMK | 221 |
| | | 2284.90 | ETLIDAMEHPEEYPQLTIR | 32 |
| | | 2575.08 | FLHSLDNLGPAPEPNLTVLWSVR | 222 |
| | | 2628.01 | SGAQVGPNFEGINSEVLEYDEVFK | 223 |
| | | 2756.06 | SGAQVGPNFEGINSEVLEYDEVFKK | 224 |
| | | 3262.33 | VASTITSHDAGYLDKDLETIVGVQTEKPFK | 225 |
| P479 | 80 | 625.27 | HVDVR | 1 |
| | | 736.26 | IIGDYR | 226 |
| | | 814.22 | IFTDYR | 227 |
| | | 942.27 | IFTDYRK | 4 |
| | | 974.26 | YAQVKPIR | 6 |
| | | 984.18 | QMQFFGAR | 7 |
| | | 992.23 | SMQPFGGIR | 8 |
| | | 1087.16 | EQQLDVISR | 228 |
| | | 1097.24 | VSGYAVNFIK | 9 |
| | | 1159.12 | NHATAWQGFK | 10 |
| | | 1243.14 | VDDIAVDLVER | 229 |
| | | 1261.22 | LWEQVMQLSK | 11 |
| | | 1272.24 | SLGKEPEDQNR | 12 |
| | | 1277.18 | DGISNTFSIVPK | 13 |

TABLE 4-continued

Characteristics of polypeptides obtained from *S. aureus* isolate 2176.

| Polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| | | 1289.21 | AGVITGLPDAYGR | 14 |
| | | 1315.19 | TSTFLDIYAER | 15 |
| | | 1322.21 | LREELSEQYR | 230 |
| | | 1394.16 | THNQGVFDAYSR | 17 |
| | | 1417.32 | KAGVITGLPDAYGR | 18 |
| | | 1426.23 | IEMALHDTEIVR | 20 |
| | | 1487.19 | NHATAWQGFKNGR | 231 |
| | | 1508.25 | AGEPFAPGANPMHGR | 21 |
| | | 1513.21 | VALYGVDFLMEEK | 22 |
| | | 1522.25 | KTHNQGVFDAYSR | 23 |
| | | 1543.26 | YGFDLSRPAENFK | 24 |
| | | 1571.23 | TSSIQYENDDIMR | 25 |
| | | 1636.29 | KAGEPFAPGANPMHGR | 26 |
| | | 1703.43 | DLETIVGVQTEKPFK | 232 |
| | | 1751.45 | EAVQWLYLAYLAAIK | 233 |
| | | 1859.53 | DLETIVGVQTEKPFKR | 234 |
| | | 1876.50 | TMATGIAGLSVAADSLSAIK | 235 |
| | | 1936.37 | NEEGLVVDFEIEGDFPK | 236 |
| | | 2042.43 | MHDFNTMSTEMSEDVIR | 30 |
| | | 2077.45 | YGNNDDRVDDIAVDLVER | 31 |
| | | 2158.57 | AGVITESEVQEIIDHFIMK | 237 |
| | | 2284.61 | ETLIDAMEHPEEYPQLTIR | 32 |
| | | 2574.77 | FLHSLDNLGPAPEPNLTVLWSVR | 238 |
| | | 2627.61 | SGAQVGPNFEGINSEVLEYDEVFK | 239 |
| | | 2755.70 | SGAQVGPNFEGINSEVLEYDEVFKK | 240 |
| | | 2907.65 | EFIQLNYTLYEGNDSFLAGPTEATSK | 241 |
| | | 3261.91 | VASTITSHDAGYLDKDLETIVGVQTEKPFK | 242 |
| | | 3421.02 | TPDYNELFSGDPTWVTESIGGVGIDGRPLVTK | 243 |
| P480 | 65 | 625.35 | HVDVR | 1 |
| | | 717.38 | YSYER | 2 |
| | | 733.42 | LPDNFK | 244 |
| | | 736.44 | IIGDYR | 245 |
| | | 814.33 | IFTDYR | 246 |
| | | 853.31 | YGNNDDR | 247 |
| | | 942.33 | IFTDYRK | 4 |
| | | 944.39 | ELKELGQK | 5 |
| | | 974.52 | YAQVKPIR | 6 |

TABLE 4-continued

Characteristics of polypeptides obtained from S. aureus isolate 2176.

| Polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| | | 984.36 | QMQFFGAR | 7 |
| | | 992.44 | SMQPFGGIR | 8 |
| | | 1049.44 | TLLYAINGGK | 248 |
| | | 1087.43 | EQQLDVISR | 249 |
| | | 1097.51 | VSGYAVNFIK | 9 |
| | | 1159.52 | NHATAWQGFK | 10 |
| | | 1289.53 | AGVITGLPDAYGR | 14 |
| | | 1315.51 | TSTFLDIYAER | 15 |
| | | 1322.46 | LREELSEQYR | 250 |
| | | 1394.50 | THNQGVFDAYSR | 17 |
| | | 1417.65 | KAGVITGLPDAYGR | 18 |
| | | 1442.56 | IEMALHDTEIVR + Oxidation (M) | 251 |
| | | 1467.60 | VSGYAVNFIKLTR | 252 |
| | | 1522.61 | KTHNQGVFDAYSR | 23 |
| | | 1524.55 | AGEPFAPGANPMHGR + Oxidation (M) | 253 |
| | | 1529.64 | VALYGVDFLMEEK + Oxidation (M) | 254 |
| | | 1543.62 | YGFDLSRPAENFK | 24 |
| | | 1652.68 | KAGEPFAPGANPMHGR + Oxidation (M) | 255 |
| | | 1671.76 | TSTFLDIYAERDLK | 256 |
| | | 1766.76 | VDDIAVDLVERFMTK + Oxidation (M) | 257 |
| | | 1876.86 | TMATGIAGLSVAADSLSAIK | 258 |
| | | 2077.93 | YGNNDDRVDDIAVDLVER | 31 |
| | | 2225.07 | DSEHTMSVLTITSNVVYGKK + Oxidation (M) | 259 |
| | | 2575.33 | FLHSLDNLGPAPEPNLTVLWSVR | 260 |
| | | 2628.25 | SGAQVGPNFEGINSEVLEYDEVFK | 261 |
| | | 2748.36 | NLTSMLDGYAMQCGHHLNINVFNR | 262 |
| | | 2756.63 | SGAQVGPNFEGINSEVLEYDEVFKK | 263 |
| | | 3001.02 | DEKSGAQVGPNFEGINSEVLEYDEVFK | 264 |
| | | 3420.75 | TPDYNELFSGDPTWVTESIGGVGIDGRPLVTK | 265 |
| P481 | 55 | 634.33 | AKSNSK | 266 |
| | | 883.24 | TFYPEAR | 267 |
| | | 1014.24 | QFWGHLVK | 268 |
| | | 1131.17 | WIPLMMKGR | 269 |
| | | 1207.21 | VINEEFEISK | 270 |
| | | 1324.10 | NEDWQLYTAGK | 271 |
| | | 1360.28 | TLLFGPFANVGPK | 272 |

TABLE 4-continued

Characteristics of polypeptides obtained from *S. aureus* isolate 2176.

| Polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| | | 1386.31 | LDRPAIESSNER | 273 |
| | | 1565.30 | IDEGTDVNFGELTR | 274 |
| | | 1584.34 | EFINPLPHISYVR | 275 |
| | | 1699.29 | EIEPDWNIHVYER | 276 |
| | | 1744.36 | EPPGTPPMTVPHLDTR | 277 |
| | | 2046.52 | QVTDYVFIGAGGGAIPLLQK | 278 |
| | | 2189.43 | TFYPEARNEDWQLYTAGK | 279 |
| | | 2806.58 | HLGGFPISGQFLACTNPQVIEQHDAK | 280 |
| P482 | 37 | 699.28 | FEYIK | 281 |
| | | 729.26 | DAWPLK | 282 |
| | | 792.33 | ASVVNFR | 283 |
| | | 852.28 | VYDQLSK | 284 |
| | | 1008.30 | LIDDLYEK | 285 |
| | | 1020,31 | YKDAWPLK | 286 |
| | | 1083.43 | LKPDLIVASK | 287 |
| | | 1278.36 | IAPTVSTDTVFK | 288 |
| | | 1623.44 | IVGQEPAPNLEEISK | 289 |
| | | 1712.62 | ESIPLMNADHIFVVK | 290 |
| | | 1800.61 | IYAGGYAGEILNDLGFK | 291 |
| | | 1956.77 | IYAGGYAGEILNDLGFKR | 292 |
| | | 2251.77 | NNQVSDDLDEITWNLAGGYK | 293 |
| | | 3227.44 | VVTLYQGATDVAVSLGVKPVGAVESWTQKPK | 294 |
| P483 | 36 | 646.50 | DVWAR | 295 |
| | | 672.41 | KLNAVK | 296 |
| | | 716.41 | VDIVDR | 297 |
| | | 725.61 | IIKPVR | 298 |
| | | 842.50 | IAPTLSLK | 299 |
| | | 850.47 | QNINSFK | 300 |
| | | 1068.50 | IGDYTSVGTR | 301 |
| | | 1075.42 | MIIMTDHAK + Oxidation (M) | 302 |
| | | 1185.53 | KQPNLEEISK | 303 |
| | | 1327.59 | LKPDLIIADSSR | 304 |
| | | 1343.58 | VDIVDRDVWAR | 305 |
| | | 1592.76 | LKPDLIIADSSRHK | 306 |
| | | 2081.00 | GPYLQLDTEHLADLNPER | 307 |
| | | 2438.24 | AGLLAHPNYSYVGQFLNELGFK | 308 |

TABLE 4-continued

Characteristics of polypeptides obtained from S. aureus isolate 2176.

| Polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| | | 2789.48 | IVVLEYSFADALAALDVKPVGIADDGK | 309 |
| | | 2917.60 | IVVLEYSFADALAALDVKPVGIADDGKK | 310 |
| P484 | 35 | 857.38 | AAAIDLAGR | 311 |
| | | 1022.23 | NIEADTGMR + Oxidation (M) | 312 |
| | | 1056.32 | VVDANIAAQR | 313 |
| | | 1075.36 | ADIDLPFER | 314 |
| | | 1285.44 | LVGGAGEETIIAR | 315 |
| | | 1435.44 | AMAVATEQEMKAR | 316 |
| | | 1632.50 | HHTEVLENPDNISK | 317 |
| | | 1813.65 | VVEAESEVPLAMAEALR | 318 |
| | | 1887.67 | VIETPFIAGVAMNGIEVK | 319 |
| | | 2299.85 | AGLALTTNQLESHYLAGGNVDR | 320 |
| | | 2806.95 | TVLSKGLDSGTAFEILSIDIADVDISK | 321 |
| | | 3337.42 | AGLALTTNQLESHYLAGGNVDRVVDANIAAQR | 322 |
| P485 | 33 | 625.28 | ADYEK | 323 |
| | | 864.28 | YIAQLEK | 324 |
| | | 946.23 | QGTPEQMR | 325 |
| | | 1045.26 | ALEQAGKSLK | 326 |
| | | 1268.35 | HLLVETSVDKK | 327 |
| | | 1443.34 | DIFGEVYTDSIGK | 328 |
| | | 1450.40 | TIQQTFIDNDKK | 329 |
| | | 1454.37 | VVTTNSILYDMAK | 330 |
| | | 1571.45 | KDIFGEVYTDSIGK | 331 |
| | | 1576.44 | DVKPIYLNGEEGNK | 332 |
| | | 1593.47 | QDPHAWLSLDNGIK | 333 |
| | | 1819.59 | DVKPIYLNGEEGNKDK | 334 |
| | | 1836.62 | DKQDPHAWLSLDNGIK | 335 |
| | | 1911.66 | QYGITPGYIWEINTEK | 336 |
| | | 2172.83 | VIAVSKDVKPIYLNGEEGNK | 337 |
| | | 2582.00 | LTDADVILYNGLNLETGNGWFEK | 338 |
| | | 2942.26 | NVGGDNVDIHSIVPVGQDPHEYEVKPK | 339 |
| P486 | 32 | 625.42 | ADYEK | 340 |
| | | 864.41 | YIAQLEK | 341 |
| | | 1268.48 | HLLVETSVDKK | 342 |
| | | 1443.49 | DIFGEVYTDSIGK | 343 |
| | | 1450.53 | TIQQTFIDNDKK | 344 |

TABLE 4-continued

Characteristics of polypeptides obtained from S. aureus isolate 2176.

| Polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| | | 1454.61 | VVTTNSILYDMAK | 345 |
| | | 1576.64 | DVKPIYLNGEEGNK | 346 |
| | | 1593.57 | QDPHAWLSLDNGIK | 347 |
| | | 1818.77 | DVKPIYLNGEEGNKDK | 348 |
| | | 1836.78 | DKQDPHAWLSLDNGIK | 349 |
| | | 1911.81 | QYGITPGYIWEINTEK | 350 |
| | | 2582.18 | LTDADVILYNGLNLETGNGWFEK | 351 |
| | | 2942.32 | NVGGDNVDIHSIVPVGQDPHEYEVKPK | 352 |

[1]Molecular weight as determined by SDS-PAGE.
[2]The m/z value of a polypeptide fragment can be converted to mass by subtracting 1 from the m/z value. Each mass includes a range of plus or minus 400 parts per million (ppm) or 1 Dalton.

TABLE 5

Characteristics of polypeptides obtained from S. aureus bovine isolate 1477.

| polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| P487 | 88 | 717.39 | YSYER | 2 |
| | | 736.52 | IIGDYR | 583 |
| | | 814.46 | IFTDYR | 584 |
| | | 942.46 | IFTDYRK | 4 |
| | | 974.54 | YAQVKPIR | 6 |
| | | 984.41 | QMQFFGAR | 7 |
| | | 992.40 | SMQPFGGIR | 8 |
| | | 1087.49 | EQQLDVISR | 585 |
| | | 1097.50 | VSGYAVNFIK | 9 |
| | | 1159.39 | NHATAWQGFK | 10 |
| | | 1261.45 | LWEQVMQLSK | 11 |
| | | 1272.50 | SLGKEPEDQNR | 12 |
| | | 1277.50 | DGISNTFSIVPK | 13 |
| | | 1289.54 | AGVITGLPDAYGR | 14 |
| | | 1315.54 | TSTFLDIYAER | 15 |
| | | 1322.53 | LREELSEQYR | 586 |
| | | 1394.50 | THNQGVFDAYSR | 17 |
| | | 1417.62 | KAGVITGLPDAYGR | 18 |
| | | 1426.65 | IEMALHDTEIVR | 20 |
| | | 1508.59 | AGEPFAPGANPMHGR | 21 |
| | | 1522.61 | KTHNQGVFDAYSR | 23 |

TABLE 5-continued

Characteristics of polypeptides obtained from S. aureus bovine isolate 1477.

| polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| | | 1543.68 | YGFDLSRPAENFK | 24 |
| | | 1877.74 | TMATGIAGLSVAADSLSAIK | 587 |
| | | 2077.86 | YGNNDDRVDDIAVDLVER | 31 |
| | | 2159.08 | AGVITESEVQEIIDHFIMK | 588 |
| | | 2285.07 | ETLIDAMEHPEEYPQLTIR | 32 |
| | | 2575.32 | FLHSLDNLGPAPEPNLTVLWSVR | 589 |
| | | 2628.24 | SGAQVGPNFEGINSEVLEYDEVFK | 590 |
| | | 2756.41 | SGAQVGPNFEGINSEVLEYDEVEKK | 591 |
| | | 3262.68 | VASTITSHDAGYLDKDLETWGVQTEKPFK | 592 |
| P488 | 80 | 625.49 | HVDVR | 1 |
| | | 814.54 | IFTDYR | 593 |
| | | 942.66 | IFTDYRK | 4 |
| | | 974.69 | YAQVKPIR | 6 |
| | | 984.59 | QMQFFGAR | 7 |
| | | 992.55 | SMQPFGGIR | 8 |
| | | 1159.64 | NHATAWGFK | 10 |
| | | 1261.63 | LWEQVMQLSK | 11 |
| | | 1272.74 | SLGKEPEDQNR | 12 |
| | | 1277.69 | DGISNTFSIVPK | 13 |
| | | 1289.76 | AGVITGLPDAYGR | 14 |
| | | 1315.73 | TSTFLDIYAER | 15 |
| | | 1322.72 | SMQPFGGIRMAK | 16 |
| | | 1394.73 | THNQGVFDAYSR | 17 |
| | | 1417.86 | KAGVITGLPDAYGR | 18 |
| | | 1422.76 | TLLYAINGGKDEK | 19 |
| | | 1426.80 | IEMALHDTEIVR | 20 |
| | | 1508.82 | AGEPFAPGANPMHGR | 21 |
| | | 1513.80 | VALYGVDFLMEEK | 22 |
| | | 1543.82 | YGFDLSRPAENFK | 24 |
| | | 1571.82 | TSSIQYENDDIMR | 25 |
| | | 1703.99 | DLETIVGVQTEKPFK | 594 |
| | | 1860.23 | DLETIVGVQTEKPFKR | 595 |
| | | 1877.07 | TMATGIAGLSVAADSLSAIK | 596 |
| | | 1937.09 | NEEGLVVDFEIEGDFPK | 597 |
| | | 2078.13 | YGNNDDRVDDIAVDLVER | 31 |

TABLE 5-continued

Characteristics of polypeptides obtained from S. aureus bovine isolate 1477.

| polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| | | 2575.56 | FLHSLDNLGPAPEPNLTVLWSVR | 598 |
| | | 2628.30 | SGAQVGPNFEGINSEVLEYDEVFK | 599 |
| | | 2908.63 | EFIQLNYTLYEGNDSFLAGPTEATSK | 600 |
| P489 | 65 | 733.67 | IVKFAR | 601 |
| | | 944.71 | ELKELGQK | 5 |
| | | 974.79 | YAQVKPIR | 6 |
| | | 984.69 | QMQFFGAR | 7 |
| | | 1049.83 | TLLYAINGGK | 602 |
| | | 1087.78 | EQQLDVISR | 603 |
| | | 1097.79 | VSGYAVNFIK | 9 |
| | | 1243.80 | VDDIAVDLVER | 604 |
| | | 1272.82 | SLGKEPEDQNR | 12 |
| | | 1289.87 | AGVITGLPDAYGR | 14 |
| | | 1299.92 | LPDNFKTYCAK | 605 |
| | | 1315.83 | TSTFLDIYAER | 15 |
| | | 1322.84 | SMQPFGGIRMAK | 16 |
| | | 1390.93 | DQKGALSSLSSVAK | 606 |
| | | 1394.84 | THNQGVFDAYSR | 17 |
| | | 1577.94 | VASTITSHDAGYLDK | 607 |
| | | 1637.09 | KAGEPFAPGANPMHGR | 26 |
| | | 1704.16 | DLETIVGVQTEKPFK | 608 |
| | | 2030.42 | MSIKTSSIQYENDDIMR. | 608 |
| | | 2078.34 | YGNNDDRVDDIAVDLVER | 31 |
| | | 2284.60 | ETLIDAMEHPEEYPQLTIR | 32 |
| | | 2575.77 | FLHSLDNLGPAPEPNLTVLWSVR | 610 |
| | | 2628.64 | SGAQVGPNFEGINSEVLEYDEVEK | 611 |
| P490 | 55 | 883.81 | TFYPEAR | 612 |
| | | 1014.87 | QFWGHLVK | 613 |
| | | 1131.97 | WIPLMMKGR | 614 |
| | | 1207.99 | VINEEFEISK | 615 |
| | | 1231.97 | YSFDQVIMTK | 616 |
| | | 1325.02 | NEDWQLYTAGK | 617 |
| | | 1361.17 | TLLFGPFANVGPK | 618 |
| | | 1362.14 | GREDNPGIMAASK + Oxidation (M) | 619 |
| | | 1387.14 | LDRPAIESSNER | 620 |
| | | 1481.24 | NEDWQLYTAGKR | 621 |

TABLE 5-continued

Characteristics of polypeptides obtained from S. aureus bovine isolate 1477.

| polypeptide designation | Approximate molecular weight in kilodaltons (kDa)[1] | m/z value of polypeptide fragments resulting from trypsin digest[2] | Predicted amino acid sequence of the polypeptide fragment | SEQ ID NO: |
|---|---|---|---|---|
| | | 1566.28 | IDEGIDVNFGELTR | 622 |
| | | 1585.34 | EFINPLPHISYVR | 623 |
| | | 1700.36 | EIEPDWNIHVYER | 624 |
| | | 1761.49 | EPPGTPPMTVPHLDTR + Oxidation (M) | 625 |
| | | 2047.67 | QVTDYVFIGAGGGAIPLLQK | 626 |
| | | 2208.82 | VYGKEPPGTPPMTVPHLDTR + Oxidation (M) | 627 |
| | | 2865.21 | HLGGFPISGQFLACTNPQVIEQHDAK | 628 |
| P492 | 36 | 857.57 | AAAIDLAGR | 629 |
| | | 1056.59 | VVDANIAAQR | 630 |
| | | 1075.61 | ADIDLPFER | 631 |
| | | 1285.74 | LVGGAGEETIIAR | 632 |
| | | 1632.95 | HHTEVLENPDNISK | 633 |
| | | 1814.09 | VVEAESEVPLAMAEALR | 634 |
| | | 2284.45 | AAAIDLAGRDVLEAVQMSVNPK + Oxidation (M) | 635 |
| | | 2300.40 | AGLALTTNQLESHYLAGGNVDR | 636 |
| | | 2807.80 | TVLSKGLDSGTAFEILSIDIADVDISK | 637 |
| P493 | 35 | 762.46 | FVFHGR | 638 |
| | | 964.39 | DGFNNIER | 639 |
| | | 1363.56 | GHVYNGISGGQFK | 640 |
| | | 1443.56 | YTPTSILYFNPK | 641 |
| | | 1450.64 | QLAEDLQKHLGAK | 642 |
| | | 1819.88 | NHSEYVTDMRLIGIR + Oxidation (M) | 643 |
| | | 1875.84 | DLPPMEQVFDTLDLDK | 644 |
| | | 1941.00 | IRPEDMHIMANIFLPK + Oxidation (M) | 645 |
| | | 2081.10 | RIRPEDMHIMANIFLPK | 646 |
| | | 2283.30 | ISHLVLTRTGLYIIDSQLLK | 647 |
| P495 | 32 | | | |

[1]Molecular weight as determined by SDS-PAGE.
[2]The m/z value of a polypeptide fragment can be converted to mass by subtracting 1 from the m/z value. Each mass includes a range of plus or minus 430 parts per million (ppm) or 1 Dalton.

In this context, "sequence identity" refers to the identity between two polynucleotide sequences. Sequence identity is generally determined by aligning the bases of the two polynucleotides (for example, aligning the nucleotide sequence of the candidate sequence and a nucleotide sequence that includes, for example, the nucleotide sequence of SEQ ID NO:474 or SEQ ID NO:485) to optimize the number of identical nucleotides along the lengths of their sequences; gaps in either or both sequences are permitted in making the alignment in order to optimize the number of shared nucleotides, although the nucleotides in each sequence must nonetheless remain in their proper order. A candidate sequence is the sequence being compared to a known sequence—e.g., a nucleotide sequence that includes the nucleotide sequence of, for example, SEQ ID NO:474 or SEQ ID NO:485. For example, two polynucleotide sequences can be compared using the Blastn program of the BLAST 2 search algorithm, as described by Tatiana et al., *FEMS Microbiol Lett.,* 1999; 174: 247-250, and available on the world wide web at ncbi.nlm.nih.gov/BLAST/. The default values for all BLAST 2 search parameters may be used, including reward for match=1, penalty for mismatch=−2, open gap penalty=5, extension gap penalty=2, gap x_dropoff=50, expect=10, wordsize=11, and filter on.

For example, a polynucleotide of the invention can include a polynucleotide that encodes a polypeptide commonly known as formate acetyltransferase (PflB). One embodiment of such a polynucleotide is reflected in SEQ ID NO:430. Variant embodiments are reflected in SEQ ID NO:431, SEQ ID NO:432, SEQ ID NO:433, SEQ ID NO:434, SEQ ID NO:435, SEQ ID NO:436, SEQ ID NO:437, SEQ ID NO:438, SEQ ID NO:439, and SEQ ID NO:440.

As another example, a polynucleotide of the invention can include a polynucleotide that encodes a polypeptide commonly known as oligopeptide permease, peptide-binding protein (Opp1A). One embodiment of such a polynucleotide is reflected in SEQ ID NO:441. Variant embodiments are reflected in SEQ ID NO:442, SEQ ID NO:443, SEQ ID NO:444, SEQ ID NO:445, SEQ ID NO:446, SEQ ID NO:447, SEQ ID NO:448, SEQ ID NO:449, SEQ ID NO:450, and SEQ ID NO:451.

As another example, a polynucleotide of the invention can include a polynucleotide that encodes a polypeptide commonly known as siderophore compound ABC transporter binding protein (SirA). One embodiment of such a polynucleotide is reflected in SEQ ID NO:452. Variant embodiments are reflected in SEQ ID NO:453, SEQ ID NO:454, SEQ ID NO:455, SEQ ID NO:456, SEQ ID NO:457, SEQ ID NO:458, SEQ ID NO:459, SEQ ID NO:460, SEQ ID NO:461, and SEQ ID NO:462.

As another example, a polynucleotide of the invention can include a polynucleotide that encodes a polypeptide referred to herein as SYN2. One embodiment of such a polynucleotide is reflected in SEQ ID NO:463. Variant embodiments are reflected in SEQ ID NO:464, SEQ ID NO:465, SEQ ID NO:466, SEQ ID NO:467, SEQ ID NO:468, SEQ ID NO:469, SEQ ID NO:470, SEQ ID NO:471, SEQ ID NO:472, and SEQ ID NO:473.

As another example, a polynucleotide of the invention can include a polynucleotide that encodes a polypeptide commonly known as FhuD. One embodiment of such a polynucleotide is reflected in SEQ ID NO:474. Variant embodiments are reflected in SEQ ID NO:475, SEQ ID NO:476, SEQ ID NO:477, SEQ ID NO:478, SEQ ID NO:479, SEQ ID NO:480, SEQ ID NO:481, SEQ ID NO:482, SEQ ID NO:483, and SEQ ID NO:484.

As another example, a polynucleotide of the invention can include a polynucleotide that encodes a polypeptide referred to herein as SYN1. One embodiment of such a polynucleotide is reflected in SEQ ID NO:485. Variant embodiments are reflected in SEQ ID NO:486, SEQ ID NO:487, SEQ ID NO:488, SEQ ID NO:489, SEQ ID NO:490, SEQ ID NO:491, SEQ ID NO:492, SEQ ID NO:493, SEQ ID NO:494, and SEQ ID NO:495.

As another example, a polynucleotide of the invention can include a polynucleotide that encodes a polypeptide commonly known as MntC. One embodiment of such a polynucleotide is reflected in SEQ ID NO:496. Variant embodiments are reflected in SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, and SEQ ID NO:506.

As another example, a polynucleotide of the invention can include a polynucleotide that encodes a polypeptide commonly known as ferrichrome ABC transporter lipoprotein (SstD). Embodiments of such a polynucleotide are reflected in SEQ ID NO:563, SEQ ID NO:564, SEQ ID NO:565, SEQ ID NO:566, SEQ ID NO:567, SEQ ID NO:568, SEQ ID NO:569, SEQ ID NO:570, SEQ ID NO:571, and SEQ ID NO:572.

As another example, a polynucleotide of the invention can include a polynucleotide that encodes a polypeptide commonly known as iron compound ABC transporter (FhuD2). Embodiments of such a polynucleotide are reflected in SEQ ID NO:573, SEQ ID NO:574, SEQ ID NO:575, SEQ ID NO:576, SEQ ID NO:577, SEQ ID NO:578, SEQ ID NO:579, SEQ ID NO:580, SEQ ID NO:581, and SEQ ID NO:582.

Also provided by the present invention are whole cell preparations of a microbe, where the microbe expresses one or more of the polypeptides of the present invention. The cells present in a whole cell preparation are preferably inactivated such that the cells cannot replicate, but the immunological activity of the polypeptides of the present invention expressed by the microbe is maintained. Typically, the cells are killed by exposure to agents such as glutaraldehyde, formalin, or formaldehyde.

Compositions

A composition of the present invention may include at least one isolated polypeptide described herein, or a number of polypeptides that is an integer greater than one (e.g., at least two, at least three, at least four). For example, a composition can include an isolated polypeptide that includes the amino acid sequence of SEQ ID NO:408 and/or an isolated polypeptide that includes the amino acid sequence of SEQ ID NO:397. Unless a specific level of sequence similarity and/or identity is expressly indicated herein (e.g., at least 80% sequence similarity, at least 90% sequence identity, etc.), reference to the amino acid sequence of an identified SEQ ID NO includes variants having the levels of sequence similarity and/or the levels of sequence identity described herein in the section headed "Polypeptide sequence similarity and polypeptide sequence identity."

In some embodiments, the composition can include one or more additional isolated polypeptides. In some embodiments, the additional isolated polypeptide or polypeptides may include one or more metal-regulated polypeptides. Thus, a composition can include at least one isolated metal-regulated polypeptide that includes an amino acid sequence depicted in one or more of SEQ ID NO:353 through SEQ ID NO:429 and/or one or more of SEQ ID NO:543 through SEQ ID NO:562. In addition or in the alternative, a composition can include at least one isolated metal-regulated polypeptide having a molecular weight of 88 kDa, 55 kDa, 38 kDa, 37 kDa, 36 kDa, 35 kDa, or 33 kDa. In addition or in the alternative, a composition can include at least one metal-regulated isolated polypeptide that includes an amino acid sequence encoded by a polynucleotide that includes a nucleotide sequence depicted in one or more of SEQ ID NO:430 through SEQ ID NO:506 and/or one or more of SEQ ID NO:563 through SEQ ID NO:582.

In one embodiment, the composition includes a polypeptide that includes the amino acid sequence depicted in SEQ ID NO:397 (or a variant thereof such as, for example, any one of the amino acid sequences depicted in SEQ ID NO:398, SEQ ID NO:399, SEQ ID NO:400, SEQ ID NO:401, SEQ ID NO:402, SEQ ID NO:403, SEQ ID NO:404, SEQ ID NO:405, SEQ ID NO:406, or SEQ ID NO:407).

In another embodiment, the composition includes a polypeptide that includes the amino acid sequence depicted in SEQ ID NO:408 (or a variant thereof such as, for example, any one of the amino acid sequences depicted in SEQ ID NO:409, SEQ ID NO:410, SEQ ID NO:411, SEQ ID NO:412, SEQ ID NO:413, SEQ ID NO:414, SEQ ID NO:415, SEQ ID NO:416, SEQ ID NO:417, or SEQ ID NO:418).

In another embodiment, the composition includes a polypeptide that includes the amino acid sequence depicted in SEQ ID NO:419 (or a variant thereof such as, for example, any one of the amino acid sequences depicted in SEQ ID NO:420, SEQ ID NO:421, SEQ ID NO:422, SEQ ID NO:423, SEQ ID NO:424, SEQ ID NO:425, SEQ ID NO:426, SEQ ID NO:427, SEQ ID NO:428, or SEQ ID NO:429).

In another embodiment, the composition includes a polypeptide that includes the amino acid sequence depicted in SEQ ID NO:375 (or a variant thereof such as, for example, any one of the amino acid sequences depicted in SEQ ID NO:376, SEQ ID NO:377, SEQ ID NO:378, SEQ ID NO:379, SEQ ID NO:380, SEQ ID NO:381, SEQ ID NO:382, SEQ ID NO:383, SEQ ID NO:384, or SEQ ID NO:385).

In another embodiment, the composition includes a polypeptide that includes the amino acid sequence depicted in SEQ ID NO:386 (or a variant thereof such as, for example, any one of the amino acid sequences depicted in SEQ ID NO:387, SEQ ID NO:388, SEQ ID NO:389, SEQ ID NO:390, SEQ ID NO:391, SEQ ID NO:392, SEQ ID NO:393, SEQ ID NO:394, SEQ ID NO:395, or SEQ ID NO:396).

In another embodiment, the composition includes a polypeptide that includes the amino acid sequence depicted in SEQ ID NO:364 (or a variant thereof such as, for example, any one of the amino acid sequences depicted in SEQ ID NO:365, SEQ ID NO:366, SEQ ID NO:367, SEQ ID NO:368, SEQ ID NO:369, SEQ ID NO:370, SEQ ID NO:371, SEQ ID NO:372, SEQ ID NO:373, or SEQ ID NO:374).

In another embodiment, the composition includes a polypeptide that includes the amino acid sequence depicted in SEQ ID NO:353 (or a variant thereof such as, for example, any one of the amino acid sequences depicted in SEQ ID NO:354, SEQ ID NO:355, SEQ ID NO:356, SEQ ID NO:357, SEQ ID NO:358, SEQ ID NO:359, SEQ ID NO:360, SEQ ID NO:361, SEQ ID NO:362, or SEQ ID NO:363).

In another embodiment, the composition includes a polypeptide that includes the amino acid sequence, or a variant thereof, of any one of the amino acid sequences depicted in SEQ ID NO:543, SEQ ID NO:544, SEQ ID NO:545, SEQ ID NO:546, SEQ ID NO:547, SEQ ID NO:548, SEQ ID NO:549, SEQ ID NO:550, SEQ ID NO:551, or through SEQ ID NO:552.

In another embodiment, the composition includes a polypeptide that includes the amino acid sequence, or variant thereof, of any one of the amino acid sequences depicted in SEQ ID NO:553, SEQ ID NO:554, SEQ ID NO:555, SEQ ID NO:556, SEQ ID NO:557, SEQ ID NO:558, SEQ ID NO:559, SEQ ID NO:560, SEQ ID NO:561, or SEQ ID NO:562.

In some embodiments, the composition can include a combination of two or more polypeptides selected from the following: a SYN1 polypeptide, a MntC polypeptide, a FhuD polypeptide, a SYN2 polypeptide, a SirA polypeptide, an Opp1A polypeptide, and a Pflb polypeptide.

Thus, the composition can include at least one or any combination that includes at least two, at least three, at least four, at least five, at least six, or all seven of: a SYN1 polypeptide, a MntC polypeptide, a FhuD polypeptide, a SYN2 polypeptide, a SirA polypeptide, an Opp1A polypeptide, and a Pflb polypeptide. Exemplary compositions that include combinations of polypeptides are identified in Table 6.

| Composition | SYN1 | MntC | FhuD | SYN2 | SirA | Opp1A | Pflb |
|---|---|---|---|---|---|---|---|
| 2 pPeptides* | | | | | | | |
| 1 | X | X | | | | | |
| 2 | X | | X | | | | |
| 3 | X | | | X | | | |
| 4 | X | | | | X | | |
| 5 | X | | | | | X | |
| 6 | X | | | | | | X |
| 7 | | X | X | | | | |
| 8 | | X | | X | | | |
| 9 | | X | | | X | | |
| 10 | | X | | | | X | |
| 11 | | X | | | | | X |
| 12 | | | X | X | | | |
| 13 | | | X | | X | | |
| 14 | | | X | | | X | |
| 15 | | | X | | | | X |
| 16 | | | | X | X | | |
| 17 | | | | X | | X | |
| 18 | | | | X | | | X |
| 19 | | | | | X | X | |
| 20 | | | | | X | | X |
| 21 | | | | | | X | X |
| 3 pPeptides* | | | | | | | |
| 22 | X | X | X | | | | |
| 23 | X | X | | X | | | |
| 24 | X | X | | | X | | |
| 25 | X | X | | | | X | |
| 26 | X | X | | | | | X |
| 27 | X | | X | X | | | |
| 28 | X | | X | | X | | |
| 29 | X | | X | | | X | |
| 30 | X | | X | | | | X |
| 31 | X | | | X | X | | |
| 32 | X | | | X | | X | |
| 33 | X | | | X | | | X |
| 34 | X | | | | X | X | |
| 35 | X | | | | X | | X |
| 36 | X | | | | | X | X |
| 37 | | X | X | X | | | |
| 38 | | X | X | | X | | |
| 39 | | X | X | | | X | |
| 40 | | X | X | | | | X |
| 41 | | X | | X | X | | |
| 42 | | X | | X | | X | |
| 43 | | X | | X | | | X |
| 44 | | X | | | X | X | |
| 45 | | X | | | X | | X |
| 46 | | X | | | | X | X |
| 47 | | | X | X | X | | |
| 48 | | | X | X | | X | |
| 49 | | | X | X | | | X |
| 50 | | | X | | X | X | |
| 51 | | | X | | X | | X |
| 52 | | | X | | | X | X |
| 53 | | | | X | X | X | |
| 54 | | | | X | X | | X |
| 55 | | | | X | | X | X |
| 56 | | | | | X | X | X |
| 4 pPeptides* | X | X | X | X | | | |
| 57 | X | X | X | | X | | |
| 58 | X | X | X | | | X | |
| 59 | X | X | X | | | | X |
| 60 | X | X | | X | X | | |
| 61 | X | X | | X | | X | |
| 62 | X | X | | X | | | X |
| 63 | X | X | | | X | X | |
| 64 | X | X | | | X | | X |
| 65 | X | X | | | | X | X |
| 67 | X | X | | | | X | X |
| 68 | X | | X | X | X | | |
| 69 | X | | X | X | | X | |
| 70 | X | | X | X | | | X |

| Composition | SYN1 | MntC | FhuD | SYN2 | SirA | Opp1A | Pflb |
|---|---|---|---|---|---|---|---|
| 71 | X | | X | | X | X | |
| 72 | X | | X | | X | | X |
| 73 | X | | X | | | X | X |
| 74 | X | | | X | X | X | |
| 75 | X | | | X | X | | X |
| 76 | X | | | | X | X | X |
| 77 | | X | X | X | X | | |
| 78 | | X | X | X | | X | |
| 79 | | X | X | X | | | X |
| 80 | | X | X | | X | X | |
| 81 | | X | X | | X | | X |
| 82 | | X | X | | | X | X |
| 83 | | X | | X | X | X | |
| 84 | | X | | X | X | | X |
| 85 | | X | | X | | X | X |
| 86 | | X | | | X | X | X |
| 87 | | | X | X | X | X | |
| 88 | | | X | X | X | | X |
| 89 | | | X | X | | X | X |
| 90 | | | X | | X | X | X |
| 91 | | | | X | X | X | X |
| 5 pPeptides* | | | | | | | |
| 92 | X | X | X | X | X | | |
| 93 | X | X | X | X | | X | |
| 94 | X | X | X | X | | | X |
| 95 | X | X | X | | X | X | |
| 96 | X | X | X | | X | | X |
| 97 | X | X | X | | | X | X |
| 98 | X | X | | X | X | X | |
| 99 | X | X | | X | X | | X |
| 100 | X | X | | X | | X | X |
| 101 | X | X | | | X | X | X |
| 102 | X | | X | X | X | X | |
| 103 | X | | X | X | X | | X |
| 104 | X | | X | X | | X | X |
| 105 | X | | X | | X | X | X |
| 106 | X | | | X | X | X | X |
| 107 | | X | X | X | X | X | |
| 108 | | X | X | X | X | | X |
| 109 | | X | X | X | | X | X |
| 110 | | X | X | | X | X | X |
| 111 | | X | | X | X | X | X |
| 112 | | | X | X | X | X | X |
| 6 pPeptides* | | | | | | | |
| 113 | X | X | X | X | X | X | |
| 114 | X | X | X | X | X | | X |
| 115 | X | X | X | X | | X | X |
| 116 | X | X | X | | X | X | X |
| 117 | X | X | | X | X | X | X |
| 118 | X | | X | X | X | X | X |
| 119 | | X | X | X | X | X | X |

*pPeptides = polypeptides
"X" identifies polypeptides included in a particular composition.

Throughout this description, a SYN1 polypeptide may be characterized by one or more of the following: an amino acid sequence that includes the amino acid sequence depicted in any one of SEQ ID NO:408, SEQ ID NO:409, SEQ ID NO:410, SEQ ID NO:411, SEQ ID NO:412, SEQ ID NO:413, SEQ ID NO:414, SEQ ID NO:415, SEQ ID NO:416, SEQ ID NO:417, or SEQ ID NO:418, being encoded by a polynucleotide that includes the nucleic acid sequence depicted in any one of SEQ ID NO:485, SEQ ID NO:486, SEQ ID NO:487, SEQ ID NO:488, SEQ ID NO:489, SEQ ID NO:490, SEQ ID NO:491, SEQ ID NO:492, SEQ ID NO:493, SEQ ID NO:494, SEQ ID NO:495, and/or a calculated molecular weight of about 33.1 kDa.

Throughout this description, an MntC polypeptide may be characterized by one or more of the following: possessing a molecular weight as determined by SDS-PAGE of 33 kDa, a mass fingerprint at least 80% similar to the mass fingerprint of an 33 kDa metal-regulated polypeptide produced by the reference strain S. aureus ATCC isolate 19636, an amino acid sequence that includes the amino acid sequence depicted in any one of SEQ ID NO:419, SEQ ID NO:420, SEQ ID NO:421, SEQ ID NO:422, SEQ ID NO:423, SEQ ID NO:424, SEQ ID NO:425, SEQ ID NO:426, SEQ ID NO:427, SEQ ID NO:428, or SEQ ID NO:429, being encoded by a polynucleotide that includes the nucleic acid sequence depicted in any one of SEQ ID NO:496, SEQ ID NO:497, SEQ ID NO:498, SEQ ID NO:499, SEQ ID NO:500, SEQ ID NO:501, SEQ ID NO:502, SEQ ID NO:503, SEQ ID NO:504, SEQ ID NO:505, or SEQ ID NO:506, and/or a calculated molecular weight of about 34.6 kDa.

Throughout this description, a FhuD polypeptide may be characterized by one or more of the following: an amino acid sequence that includes the amino acid sequence depicted in any one of SEQ ID NO:397, SEQ ID NO:398, SEQ ID NO:399, SEQ ID NO:400, SEQ ID NO:401, SEQ ID NO:402, SEQ ID NO:403, SEQ ID NO:404, SEQ ID NO:405, SEQ ID NO:406, or SEQ ID NO:407, being encoded by a polynucleotide that includes the nucleic acid sequence depicted in any one of SEQ ID NO:474, SEQ ID NO:475, SEQ ID NO:476, SEQ ID NO:477, SEQ ID NO:478, SEQ ID NO:479, SEQ ID NO:480, SEQ ID NO:481, SEQ ID NO:482, SEQ ID NO:483, or SEQ ID NO:484, and/or a calculated molecular weight of about 35.4 kDa.

Throughout this description, a SYN2 polypeptide may be characterized by one or more of the following: a molecular weight as determined by SDS-PAGE of 36 kDa, a mass fingerprint at least 80% similar to the mass fingerprint of an 36 kDa metal-regulated polypeptide produced by the reference strain S. aureus ATCC isolate 19636, an amino acid sequence that includes the amino acid sequence depicted in any one of SEQ ID NO:386, SEQ ID NO:387, SEQ ID NO:388, SEQ ID NO:389, SEQ ID NO:390, SEQ ID NO:391, SEQ ID NO:392, SEQ ID NO:393, SEQ ID NO:394, SEQ ID NO:395, or SEQ ID NO:396, being encoded by a polynucleotide that includes the nucleic acid sequence depicted in any one of SEQ ID NO:463, SEQ ID NO:464, SEQ ID NO:465, SEQ ID NO:466, SEQ ID NO:467, SEQ ID NO:468, SEQ ID NO:469, SEQ ID NO:470, SEQ ID NO:471, SEQ ID NO:472, or SEQ ID NO:473, and/or a calculated molecular weight of about 36.5 kDa.

Throughout this description, a SirA polypeptide may be characterized by one or more of the following: a molecular weight as determined by SDS-PAGE of 37 kDa, a mass fingerprint at least 80% similar to the mass fingerprint of an 37 kDa metal-regulated polypeptide produced by the reference strain S. aureus ATCC isolate 19636, an amino acid sequence that includes the amino acid sequence depicted in any one of SEQ ID NO:375, SEQ ID NO:376, SEQ ID NO:377, SEQ ID NO:378, SEQ ID NO:379, SEQ ID NO:380, SEQ ID NO:381, SEQ ID NO:382, SEQ ID NO:383, SEQ ID NO:384, or SEQ ID NO:385, being encoded by a polynucleotide that includes the nucleic acid sequence depicted in any one of SEQ ID NO:452, SEQ ID NO:453, SEQ ID NO:454, SEQ ID NO:455, SEQ ID NO:456, SEQ ID NO:457, SEQ ID NO:458, SEQ ID NO:459, SEQ ID NO:460, SEQ ID NO:461, or SEQ ID NO:462, and/or a calculated molecular weight of about 36.6 kDa.

Throughout this description, a Opp1A polypeptide may be characterized by one or more of the following: a molecular weight as determined by SDS-PAGE of 55 kDa, a mass fingerprint at least 80% similar to the mass fingerprint of an 55 kDa metal-regulated polypeptide produced by the reference strain *S. aureus* ATCC isolate 19636, an amino acid sequence that includes the amino acid sequence depicted in any one of SEQ ID NO:364, SEQ ID NO:365, SEQ ID NO:366, SEQ ID NO:367, SEQ ID NO:368, SEQ ID NO:369, SEQ ID NO:370, SEQ ID NO:371, SEQ ID NO:372, SEQ ID NO:373, or SEQ ID NO:374, being encoded by a polynucleotide that includes the nucleic acid sequence depicted in any one of SEQ ID NO:441, SEQ ID NO:442, SEQ ID NO:443, SEQ ID NO:444, SEQ ID NO:445, SEQ ID NO:446, SEQ ID NO:447, SEQ ID NO:448, SEQ ID NO:449, SEQ ID NO:450, or SEQ ID NO:451, and/or a calculated molecular weight of about 59.9 kDa.

Throughout this description, a PflB polypeptide may be characterized by one or more of the following: a molecular weight as determined by SDS-PAGE of 88 kDa, a mass fingerprint at least 80% similar to the mass fingerprint of an 88 kDa metal-regulated polypeptide produced by the reference strain *S. aureus* ATCC isolate 19636, an amino acid sequence that includes the amino acid sequence depicted in any one of SEQ ID NO:353, SEQ ID NO:354, SEQ ID NO:355, SEQ ID NO:356, SEQ ID NO:357, SEQ ID NO:358, SEQ ID NO:359, SEQ ID NO:360, SEQ ID NO:361, SEQ ID NO:362, or SEQ ID NO:363, being encoded by a polynucleotide that includes the nucleic acid sequence depicted in any one of SEQ ID NO:430, SEQ ID NO:431, SEQ ID NO:432, SEQ ID NO:433, SEQ ID NO:434, SEQ ID NO:435, SEQ ID NO:436, SEQ ID NO:437, SEQ ID NO:438, SEQ ID NO:439, or SEQ ID NO:440, and/or a calculated molecular weight of about 84.7 kDa.

In another particular embodiment, the composition can include a combination of polypeptides such as, for example, a MntC polypeptide, a FhuD polypeptide, a SirA polypeptide, and a SYN2 polypeptide (Composition 77 of Table 6), each polypeptide being characterized as described immediately above.

In some embodiments, a composition can include one or more polypeptides that are produced recombinantly. For example, a composition can include a recombinantly-produced Pflb polypeptide such as, for example, a polypeptide that includes the amino acid sequence depicted in SEQ ID NO:353, although a recombinantly-produced Pflb polypeptide may be characterized in any manner in which a Pflb polypeptide may be characterized, as described above, in addition to being recombinantly-produced. Such a composition can include one or more recombinantly-produced polypeptides, one or more polypeptides isolated from *S. aureus*, or any combination thereof.

As another example, a composition can include a recombinantly-produced Opp1A polypeptide such as, for example, a polypeptide that includes the amino acid sequence depicted in SEQ ID NO:364, although a recombinantly-produced Opp1A polypeptide may be characterized in any manner in which an Opp1A polypeptide may be characterized, as described above, in addition to being recombinantly-produced. Such a composition can further include one or more recombinantly-produced polypeptides, one or more polypeptides isolated from *S. aureus*, or any combination thereof.

As another example, a composition can include a recombinantly-produced SirA polypeptide such as, for example, a polypeptide that includes the amino acid sequence depicted in SEQ ID NO:375, although a recombinantly-produced SirA polypeptide may be characterized in any manner in which a SirA polypeptide may be characterized, as described above, in addition to being recombinantly-produced. Such a composition can further include one or more recombinantly-produced polypeptides, one or more polypeptides isolated from *S. aureus*, or any combination thereof.

As another example, a composition can include a recombinantly-produced SYN2 polypeptide such as, for example, a polypeptide that includes the amino acid sequence depicted in SEQ ID NO:386, although a recombinantly-produced SYN2 polypeptide may be characterized in any manner in which a SYN2 polypeptide may be characterized, as described above, in addition to being recombinantly-produced. Such a composition can further include one or more recombinantly-produced polypeptides, one or more polypeptides isolated from *S. aureus*, or any combination thereof.

As another example, a composition can include a recombinantly-produced FhuD polypeptide such as, for example, a polypeptide that includes the amino acid sequence depicted in SEQ ID NO:397, although a recombinantly-produced FhuD polypeptide may be characterized in any manner in which a FhuD polypeptide may be characterized, as described above, in addition to being recombinantly-produced. Such a composition can further include one or more recombinantly-produced polypeptides, one or more polypeptides isolated from *S. aureus*, or any combination thereof.

As another example, a composition can include a recombinantly-produced SYN1 polypeptide such as, for example, a polypeptide that includes the amino acid sequence depicted in SEQ ID NO:408, although a recombinantly-produced SYN1 polypeptide may be characterized in any manner in which a SYN1 polypeptide may be characterized, as described above, in addition to being recombinantly-produced. Such a composition can further include one or more recombinantly-produced polypeptides, one or more polypeptides isolated from *S. aureus*, or any combination thereof.

As another example, a composition can include a recombinantly-produced MntC polypeptide such as, for example, a polypeptide that includes the amino acid sequence depicted in SEQ ID NO:419, although a recombinantly-produced MntC polypeptide may be characterized in any manner in which a MntC polypeptide may be characterized, as described above, in addition to being recombinantly-produced. Such a composition can further include one or more recombinantly-produced polypeptides, one or more polypeptides isolated from *S. aureus*, or any combination thereof.

In some embodiments, a recombinantly-produced polypeptide can represent an immunologically active fragment of the native version of the polypeptide. An immunologically active fragment may include amino acid additions to the amino terminal and/or carboxy terminal of the core (e.g., the amino acid sequence of SEQ ID NO: 353, SEQ ID NO: 364, SEQ ID NO: 375, SEQ ID NO: 386, SEQ ID NO: 397, SEQ ID NO: 408, or SEQ ID NO: 419) of the immunologically active fragment. In certain embodiments, any addition to the amino terminal of the core of the immunologically active fragment can include one or more amino acid additions, deletions, substitutions (collectively, "modifications"), or any combination of modification compared to longer version—e.g., wild-type or other native form—of the polypeptide. Thus, for example, in embodiments in which the immunologically active fragment includes SEQ ID NO:397, an addition to the amino terminal of SEQ ID NO:397 can include at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, or at least 26 modifications in the amino terminal addition compared to, for example, amino acids 1-26 of SEQ ID NO:399. As another example, in embodiments in which the immunologically active fragment includes SEQ ID NO:408, an addition to the amino terminal of SEQ ID NO:408 can include at least 1, at least 2, at least 3, at least 4, or at least 5 modifications in the amino terminal addition compared to, for example, amino acids 1-26 of SEQ ID NO:415.

When comparing the amino acid sequence similarity and/or amino acid sequence identity of a reference polypeptide and a candidate polypeptide of a different length (e.g., an immunologically active fragment of the reference polypeptide) the similarity and/or identity may be computed over the full length of the longer polypeptide, counting each amino acid residue of greater length in the longer polypeptide contributing as a mismatch.

In some embodiments, therefore, an isolated polypeptide of the invention can include a polypeptide having at least 92%, at least 93%, at least 94%, at least 95%, at least 96%, at least 97%, at least 98%, or at least 99% sequence similarity and/or identity to the amino acid sequence of SEQ ID NO:397, with the proviso that if the isolated polypeptide includes one or more additional amino acids at the amino terminal, the one or more additional amino acids include at least one amino acid deletion or at least one amino acid substitution compared to amino acids 1-26 of SEQ ID NO:399.

In other embodiments, an isolated polypeptide of the invention can include a polypeptide having at least 98% or at least 99% sequence similarity and/or identity to the amino acid sequence of SEQ ID NO:408, with the proviso that if the isolated polypeptide includes one or more additional amino acids at the amino terminal, the one or more additional amino acids include at least one amino acid deletion or at least one amino acid substitution compared to amino acids 1-5 of SEQ ID NO:415.

As noted above in the section headed Polypeptide sequence similarity and polypeptide sequence identity, a polypeptide identified by reference to the amino acid sequence of a particular SEQ ID NO can include a polypeptide with at least 50%, at least 55%, at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence similarity to the reference amino acid sequence (e.g., the amino acid sequence provided in a specified SEQ ID NO:) and/or a polypeptide with at least 50%, at least 55%, at least 60%, at least 65%, at least 70%, at least 75%, at least 80%, at least 85%, at least 86%, at least 87%, at least 88%, at least 89%, at least 90%, at least 91%, at least 92%, at least 93%, at least 94%, at least 95%, at least 96%, at least 97%, at least 98%, or at least 99% amino acid sequence identity to the reference amino acid sequence (e.g., the amino acid sequence provided in a specified SEQ ID NO:).

A recombinantly-produced polypeptide may be expressed from a vector that permits expression of the polypeptide when the vector is introduced into an appropriate host cell. A host cell may be constructed to produce one or more recombinantly-produced polypeptides of the invention and, therefore, can include one more vectors that include at least one polynucleotide that encodes a polypeptide of the invention. Thus, each vector can include one or more polynucleotides of the invention—i.e., a polynucleotide that encodes a polypeptide of the invention.

Certain compositions such as, for example, those including recombinantly-produced polypeptides, can include a maximum number of polypeptides. In some embodiments, the maximum number of polypeptides can refer to the maximum total number of polypeptides. Certain compositions can include, for example, no more than 50 polypeptides such as, for example, no more than 40 polypeptides, no more than 30 polypeptides, no more than 25 polypeptides, no more than 20 polypeptides, no more than 15 polypeptides, no more than 10 polypeptides, no more than eight polypeptides, no more than seven polypeptides, no more than six polypeptides, no more than five polypeptides, no more than four polypeptides, no more than three polypeptides, no more than two polypeptides, or no more than one polypeptide. In other embodiments, a maximum number of recombinantly-produced polypeptides may be specified in a similar manner. In still other embodiments, a maximum number of nonrecombinantly-produced polypeptides may be specified in a similar manner.

A composition can include polypeptides isolatable from one microbe, or can be isolatable from a combination of two or more microbes. For instance, a composition can include polypeptides isolatable from two or more *Staphyloccocus* spp., or from a *Staphyloccocus* spp. and a different microbe that is not a member of the genus *Staphyloccocus*. The present invention also provides compositions including a whole cell preparation, where the whole cell expresses one or more of the polypeptides of the present invention. For instance, the whole cell can be a *Staphyloccocus* spp. In some aspects, a composition can include whole preparations from two, three, four, five, or six strains.

Optionally, a polypeptide of the present invention can be covalently bound or conjugated to a carrier polypeptide to improve the immunological properties of the polypeptide. Useful carrier polypeptides are known in the art. The chemical coupling of polypeptides of the present invention can be carried out using known and routine methods. For instance, various homobifunctional and/or heterobifunctional cross-linker reagents such as bis(sulfosuccinimidyl) suberate, bis (diazobenzidine), dimethyl adipimidate, dimethyl pimelimidate, dimethyl superimidate, disuccinimidyl suberate, glutaraldehyde, m-maleimidobenzoyl-N-hydroxysuccinimide, sulfo-m-maleimidobenzoyl-N-hydroxysuccinimide, sulfosuccinimidyl 4-(N-maleimidomethyl)cycloheane-1-carboxylate, sulfosuccinimidyl 4-(p-maleimido-phenyl) butyrate and (1-ethyl-3-(dimethyl-aminopropyl) carbodiimide can be used (see, for instance, Harlow and Lane, Antibodies, A Laboratory Manual, generally and Chapter 5, Cold Spring Harbor Laboratory, Cold Spring Harbor, N.Y., N.Y. (1988)).

The compositions of the present invention optionally further include a pharmaceutically acceptable carrier. "Pharmaceutically acceptable" refers to a diluent, carrier, excipient, salt, etc, that is compatible with the other ingredients of the composition, and not deleterious to the recipient thereof. Typically, the composition includes a pharmaceutically acceptable carrier when the composition is used as described herein. The compositions of the present invention may be formulated in pharmaceutical preparations in a variety of forms adapted to the chosen route of administration, including routes suitable for stimulating an immune response to an antigen. Thus, a composition of the present invention can be administered via known routes including, for example, oral; parenteral including intradermal, transcutaneous and subcutaneous; intramuscular, intravenous, intraperitoneal, etc. and topically, such as, intranasal, intrapulmonary, intramammary, intravaginal, intrauterine, intradermal, transcutaneous and rectally, etc. It is foreseen that a composition can be administered to a mucosal surface, such as by administration to the nasal or respiratory mucosa (e.g., via a spray or aerosol), in order to stimulate mucosal immunity, such as production of secretory IgA antibodies, throughout the animal's body.

A composition of the present invention can also be administered via a sustained or delayed release implant. Implants suitable for use according to the invention are known and include, for example, those disclosed in Emery and Straub (WO 01/37810 (2001)), and Emery et al., (WO 96/01620 (1996)). Implants can be produced at sizes small enough to be administered by aerosol or spray. Implants also can include nanospheres and microspheres.

A composition of the present invention may be administered in an amount sufficient to treat certain conditions as described herein. The amount of polypeptides or whole cells present in a composition of the present invention can vary. For instance, the dosage of polypeptides can be between 0.01 micrograms (μg) and 300 mg, typically between 0.1 mg and 10 mg. When the composition is a whole cell preparation, the cells can be present at a concentration of, for instance, $10^2$ bacteria/ml, $10^3$ bacteria/ml, $10^4$ bacteria/ml, $10^5$ bacteria/ml, $10^6$ bacteria/ml, $10^7$ bacteria/ml, $10^8$ bacteria/ml, or $10^9$ bacteria/ml. For an injectable composition (e.g. subcutaneous, intramuscular, etc.) the polypeptides may be present in the composition in an amount such that the total volume of the composition administered is 0.5 ml to 5.0 ml, typically 1.0 to 2.0 ml. When the composition is a whole cell preparation, the cells are preferably present in the composition in an amount that the total volume of the composition administered is 0.5 ml to 5.0 ml, typically 1.0 to 2.0 ml. The amount administered will vary depending on various factors including, but not limited to, the specific polypeptides chosen, the weight, physical condition and age of the animal, and the route of administration. Thus, the absolute weight of the polypeptide included in a given unit dosage form can vary widely, and depends upon factors such as the species, age, weight and physical condition of the animal, as well as the method of administration. Such factors can be determined by one of skill in the art. Other examples of dosages suitable for the invention are disclosed in Emery et al., (U.S. Pat. No. 6,027,736).

The formulations may be conveniently presented in unit dosage form and may be prepared by methods well known in the art of pharmacy. Methods of preparing a composition with a pharmaceutically acceptable carrier include the step of bringing the active compound (e.g., a polypeptide or whole cell of the present invention) into association with a carrier that constitutes one or more accessory ingredients. In general, the formulations are prepared by uniformly and intimately bringing the active compound into association with a liquid carrier, a finely divided solid carrier, or both, and then, if necessary, shaping the product into the desired formulations.

A composition including a pharmaceutically acceptable carrier can also include an adjuvant. An "adjuvant" refers to an agent that can act in a nonspecific manner to enhance an immune response to a particular antigen, thus potentially reducing the quantity of antigen necessary in any given immunizing composition, and/or the frequency of injection necessary in order to generate an adequate immune response to the antigen of interest. Adjuvants may include, for example, IL-1, IL-2, emulsifiers, muramyl dipeptides, dimethyl dioctadecyl ammonium bromide (DDA), pyridine, aluminum hydroxide, oils, saponins, alpha-tocopherol, polysaccharides, emulsified paraffins (including, for instance, those available from under the tradename EMULSIGEN from MVP Laboratories, Ralston, Nebr.), ISA-70, RIBI and other substances known in the art. It is expected that polypeptides of the present invention will have immunoregulatory activity and that such polypeptides may be used as adjuvants that directly act as T and/or B cell activators or act on specific cell types that enhance the synthesis of various cytokines or activate intracellular signaling pathways. Such polypeptides are expected to augment the immune response to increase the protective index of the existing composition.

In another embodiment, a composition of the invention including a pharmaceutically acceptable carrier can include a biological response modifier, such as, for example, IL-2, IL-4 and/or IL-6, TNF, IFN-alpha, IFN-gamma, and other cytokines that effect immune cells. An immunizing composition can also include other components known in the art such as an antibiotic, a preservative, an anti-oxidant, or a chelating agent.

Methods of Making

The present invention also provides methods for obtaining the polypeptides described herein. The polypeptides and whole cells of the present invention may be isolatable from a member of the family Micrococcaceae, preferably, *Staphylococcus* spp., more preferably, *Staphylococcus aureus*. Other gram positive microbes from which polypeptides can be isolated include *Corynebacterium* spp., *Erysipelothrix* spp., *Mycobacterium* spp., and *Erysipelothrix* spp. Microbes useful for obtaining polypeptides of the present invention and making whole cell preparations are commercially available from a depository such as American Type Culture Collection (ATCC). In addition, such microbes are readily obtainable by techniques routine and known to the art. The microbes may be derived from an infected animal as a field isolate, and used to obtain polypeptides and/or whole cell preparations of the present invention, or stored for future use, for example, in a frozen repository at −20° C. to −95° C., or −40° C. to −50° C., in bacteriological media containing 20% glycerol, and other like media.

When a polypeptide of the present invention is to be obtained from a microbe, the microbe can be incubated under low metal conditions. As used herein, the phrase "low metal conditions" refers to an environment, typically bacteriological media, which contains amounts of a free metal that cause a microbe to express metal-regulated polypeptides at a detectable level. As used herein, the phrase "high metal conditions" refers to an environment that contains amounts of a free metal that cause a microbe to either not express one or more of the metal-regulated polypeptides described herein at a detectable level, or to express such a polypeptide at a decreased level compared to expression of the metal-regulated polypeptide under low metal conditions. In some cases, "high metal conditions" can include a metal-rich natural environment and/or culture in a metal-rich medium without a metal chelator. In contrast, in some cases, "low metal conditions" can include culture in a medium that includes a metal chelator, as described in more detail below. Metals are those present in the periodic table under Groups 1 through 17 (IUPAC notation; also referred to as Groups I-A, II-A, III-B, IV-B, V-B, VI-B, VII-B, VIII, I-B, II-B, III-A, IV-A, V-A, VI-A, and VII-A, respectively, under CAS notation). Preferably, metals are those in Groups 2 through 12, more preferably, Groups 3-12. Even more preferably, the metal is iron, zinc, copper, magnesium, nickel, cobalt, manganese, molybdenum, or selenium, most preferably, iron.

Low metal conditions are generally the result of the addition of a metal chelating compound to a bacteriological medium, the use of a bacteriological medium that contains low amounts of a metal, or the combination thereof. High metal conditions are generally present when a chelator is not present in the medium, a metal is added to the medium, or the combination thereof. Examples of metal chelators include natural and synthetic compounds. Examples of natural compounds include plant phenolic compounds, such as flavenoids. Examples of flavenoids include the copper chelators catechin and naringenin, and the iron chelators myricetin and quercetin. Examples of synthetic copper chelators include, for instance, tetrathiomolybdate, and examples of synthetic zinc chelators include, for instance, N,N,N',N'-Tetrakis(2-pyridylmethyl)-ethylene diamine. Examples of synthetic iron chelators include 2,2'-dipyridyl (also referred to in the art as $\alpha,\alpha'$-bipyridyl), 8-hydroxyquinoline, ethylenediamine-di-O-hydroxyphenylacetic acid (EDDHA), desferrioxamine methanesulphonate (desferol), transferrin, lactoferrin, ovotransferrin, biological siderophores, such as, the catecholates and hydroxamates, and citrate. An example of a general divalent cation chelator is CHELEX resin. Preferably, 2,2'-dipyridyl is used for the chelation of iron. Typically, 2,2'-dipyridyl is added to the media at a concentration of at least 300 micrograms/milliliter (µg/ml), at least 600 µg/ml, or at least 900 µg/ml. High levels of 2,2'-dipyridyl can be 1200 µg/ml, 1500 µg/ml, or 1800 µg/ml.

The *S. aureus* genome encodes three Fur homologs: Fur, PerR, and Zur. While the Zur and PerR proteins appear to be primarily involved in regulating zinc homeostasis and peroxide stress genes, respectively, the Fur protein has been demonstrated to regulate several iron-siderophore uptake systems in response to iron limitation. The Fur protein also plays a role in oxidative stress resistance and virulence. It is expected that a gram positive organism, preferably, an *S. aureus*, with a mutation in a fur gene will result in the constitutive expression of many, if not all, of the metal-regulated polypeptides of the present invention. The production of a fur mutation in a gram positive, preferably, an *S. aureus*, can be produced using routine methods including, for instance, transposon, chemical, or site-directed mutagenesis useful for generating gene knock-out mutations in gram positive bacteria.

The medium used to incubate the microbe and the volume of media used to incubate the microbe can vary. When a microbe is being evaluated for the ability to produce one or more of the polypeptides described herein, the microbe can be grown in a suitable volume, for instance, 10 milliliters to 1 liter of medium. When a microbe is being grown to obtain polypeptides for use in, for instance, administration to animals, the microbe may be grown in a fermentor to allow the isolation of larger amounts of polypeptides. Methods for growing microbes in a fermentor are routine and known to the art. The conditions used for growing a microbe preferably include a metal chelator, more preferably an iron chelator, for instance 2,2'-dipyridyl, a pH of between 6.5 and 7.5, preferably between 6.9 and 7.1, and a temperature of 37° C.

In some aspects of the invention, a microbe may be harvested after growth. Harvesting includes concentrating the microbe into a smaller volume and suspending in a media different than the growth media. Methods for concentrating a microbe are routine and known in the art, and include, for example, filtration or centrifugation. Typically, the concentrated microbe is suspended in an appropriate buffer. An example of a buffer that can be used contains Tris-base (7.3 grams/liter), at a pH of 8.5. Optionally, the final buffer also minimizes proteolytic degradation. This can be accomplished by having the final buffer at a pH of greater than 8.0, preferably, at least 8.5, and/or including one or more proteinase inhibitors (e.g., phenylmethanesulfonyl fluoride). Optionally and preferably, the concentrated microbe is frozen at −20° C. or below until disrupted.

When the microbe is to be used as a whole cell preparation, the harvested cells may be processed using routine and known methods to inactivate the cells. Alternatively, when a microbe is to be used to prepare polypeptides of the present invention, the microbe may be disrupted using chemical, physical, or mechanical methods routine and known to the art, including, for example, boiling, french press, sonication, digestion of peptidoglycan (for instance, by digestion with lysozyme), or homogenization. An example of a suitable device useful for homogenization is a model C500-B AVESTIN homogenizer, (Avestin Inc, Ottawa Canada). As used herein, "disruption" refers to the breaking up of the cell. Disruption of a microbe can be measured by methods that are routine and known to the art, including, for instance, changes in optical density. Typically, a microbe is subjected to disruption until the percent transmittance is increased by 20% when a 1:100 dilution is measured. When physical or mechanical methods are used, the temperature during disruption is typically kept low, preferably at 4° C., to further minimize proteolytic degradation. When chemical methods are used the temperature may be increased to optimize for the cell disruption. A combination of chemical, physical, and mechanical methods may also be used to solubilize the cell wall of microbe. As used herein, the term "solubilize" refers to dissolving cellular materials (e.g., polypeptides, nucleic acids, carbohydrates) into the aqueous phase of the buffer in which the microbe was disrupted, and the formation of aggregates of insoluble cellular materials. Without intending to be limited by theory, the conditions for solubilization are believed to result in the aggregation of polypeptides of the present invention into insoluble aggregates that are large enough to allow easy isolation by, for instance, centrifugation.

The insoluble aggregates that include one or more of the polypeptides of the present invention may be isolated by methods that are routine and known to the art. Preferably, the insoluble aggregates are isolated by centrifugation. Typically, centrifugation of polypeptides, such as membrane polypeptides, can be accomplished by centrifugal forces of 100,000×g. The use of such centrifugal forces requires the use of ultracentrifuges, and scale-up to process large volumes of sample is often difficult and not economical with these types of centrifuges. The methods described herein provide for the production of insoluble aggregates large enough to allow the use of continuous flow centrifuges, for instance T-1 SHARPLES (Alfa Laval Separations, Warminster, Pa.), which can be used with a flow rate of 250 ml/minute at 17 psi at a centrifugal force of 46,000×g to 60,000×g. Other large scale centrifuges can be used, such as the tubular bowl, chamber, and disc configurations. Such centrifuges are routinely used and known in the art, and are commercially available from such manufactures as Pennwalt, Westfalia and Alfa Laval.

The final harvested proteins are washed and/or dialyzed against an appropriate buffer using methods known in the art, for instance diafiltration, precipitation, hydrophobic chromatography, ion-exchange chromatography, or affinity chromatography, or ultra filtration and washing the polypeptides, for instance, in alcohol, by diafiltration. After isolation, the polypeptides suspended in buffer and stored at low temperature, for instance, −20° C. or below.

In those aspects of the present invention where a whole cell preparation is to be made, after growth a microbe can be killed with the addition of an agent such as glutaraldehyde, formalin, or formaldehyde, at a concentration sufficient to inactivate the cells in the culture. For instance, formalin can be added at a concentration of 0.3% (vol:vol). After a period of time sufficient to inactivate the cells, the cells can be harvested by, for instance, diafiltration and/or centrifugation, and washed.

In other aspects, an isolated polypeptide of the invention may be prepared recombinantly. When prepared recombinantly, a polynucleotide encoding the polypeptide may be identified and cloned into an appropriate expression host as described below in Example 14. The recombinant expression host may be grown in an appropriate medium, disrupted, and the polypeptides isolated as described above.

Methods of Use

An aspect of the present invention is further directed to methods of using the compositions of the present invention. The methods include administering to an animal an effective amount of a composition of the present invention. The animal can be, for instance, avian (including, for instance, chickens or turkeys), bovine (including, for instance, cattle), caprine (including, for instance, goats), ovine (including, for instance, sheep), porcine (including, for instance, swine), bison (including, for instance, buffalo), equine (including, for instance, horses), a companion animal (including, for instance, dogs or cats), members of the family Cervidae (including, for instance, deer, elk, moose, caribou and reindeer), or human.

In some aspects, the methods may further include additional administrations (e.g., one or more booster administrations) of the composition to the animal to enhance or stimulate a secondary immune response. A booster can be administered at a time after the first administration, for instance, one to eight weeks, preferably two to four weeks, after the first administration of the composition. Subsequent boosters can be administered one, two, three, four, or more times annually. Without intending to be limited by theory, it is expected that in some aspects of the present invention annual boosters will not be necessary, as an animal will be challenged in the field by exposure to microbes expressing polypeptides present in the compositions having epitopes that are identical to or structurally related to epitopes present on polypeptides of the composition administered to the animal.

In one aspect, the invention is directed to methods for making antibodies, for instance by inducing the production of antibody in an animal, or by recombinant techniques. The antibody produced includes antibody that specifically binds at least one polypeptide present in the composition. In this aspect of the invention, an "effective amount" is an amount effective to result in the production of antibody in the animal. Methods for determining whether an animal has produced antibodies that specifically bind polypeptides present in a composition of the present invention can be determined as described herein. The present invention further includes antibody that specifically bind to a polypeptide of the present invention, and compositions including such antibodies.

The method may be used to produce antibody that specifically binds polypeptides expressed by a microbe other than the microbe from which the polypeptides of the composition were isolated. As used herein, an antibody that can "specifically bind" a polypeptide is an antibody that interacts with the epitope of the antigen that induced the synthesis of the antibody, or interacts with a structurally related epitope. At least some of the polypeptides present in the compositions of the present invention typically include epitopes that are conserved in the polypeptides of different species and different genera of microbes. Accordingly, antibody produced using a composition derived from one microbe is expected to bind to polypeptides expressed by other microbes and provide broad spectrum protection against gram positive organisms. Examples of gram positive microbes to which the antibody may specifically bind are Micrococcaceae, preferably, *Staphylococcus* spp., more preferably, *Staphylococcus aureus*; members of the family Streptococcaceae, preferably, *Streptococcus pyogenes, Streptococcus pneumoniae, Streptococcus agalactiae, Streptococcus uberis, Streptococcus bovis, Streptococcus equi*, or *Streptococcus dysgalactiae*; and *Bacillus* spp., *Clostridium* spp., *Corynebacterium* spp., *Enterococcus* spp., *Erysipelothrix* spp., *Listeria* spp., *Micrococcus* spp., and *Mycobacterium* spp., *Kytococcus* spp., and *Erysipelothrix* spp. Therefore, antibody produced using a composition of polypeptides of the invention may be used to identify and characterize polypeptides of the invention independent of the origin, source, and/or manner of obtaining the polypeptide.

The present invention is also directed to the use of such antibody to target a microbe expressing a polypeptide of the present invention or a polypeptide having an epitope structurally related to an epitope present on a polypeptide of the present invention. A compound can be covalently bound to an antibody, where the compound can be, for instance, a toxin. Likewise, such compounds can be covalently bound to a bacterial siderophore to target the microbe. The chemical coupling or conjugation of an antibody of the present invention, or a portion thereof (such as an Fab fragment), can be carried out using known and routine methods.

In one aspect the invention is also directed to treating an infection in an animal, including a human, caused by a gram positive microbe, preferably by a member of the family Micrococcaceae, preferably, *Staphylococcus* spp., more preferably, *S. aureus*; members of the family Streptococcaceae, preferably, *Streptococcus pyogenes, Streptococcus pneumoniae, Streptococcus agalactiae, Streptococcus uberis, Streptococcus bovis, Streptococcus equi*, or *Streptococcus dysgalactiae; Bacillus* spp., *Clostridium* spp., *Corynebacterium* spp., *Enterococcus* spp., *Erysipelothrix* spp., *Kytococcus* spp., *Listeria* spp., *Micrococcus* spp., *Mycobacterium* spp., and *Erysipelothrix* spp. As used herein, the term "infection" refers to the presence of a gram positive microbe in an animal's body, which may or may not be clinically apparent. An animal with an infection by a member of the genus *Staphylococcus* that is not clinically apparent is often referred to as an asymptomatic carrier.

Treating an infection can be prophylactic or, alternatively, can be initiated after the animal is infected by the microbe. Treatment that is prophylactic—e.g., initiated before a subject is infected by a microbe or while any infection remains subclinical—is referred to herein as treatment of a subject that is "at risk" of infection. As used herein, the term "at risk" refers to an animal that may or may not actually possess the described risk. Thus, typically, an animal "at risk" of infection by a microbe is an animal present in an area where animals have been identified as infected by the microbe and/or is likely to be exposed to the microbe even if the animal has not yet manifested any detectable indication of infection by the microbe and regardless of whether the animal may harbor a subclinical amount of the microbe. Accordingly, administration of a composition can be performed before, during, or after the animal has first contact with the microbe. Treatment initiated after the animal's first contact with the microbe may result in decreasing the severity of symptoms and/or clinical signs of infection by the microbe, completely removing the microbe, and/or decreasing the likelihood of experiencing a clinically evident infection compared to an animal to which the composition is not administered. The method includes administering an effective amount of the composition of the present invention to an animal having, or at risk of having, an infection caused by a gram positive microbe, and determining whether the number of microbes causing the infection has decreased. In this aspect of the invention, an "effective amount" is an amount effective to reduce the number of the specified microbes in an animal or reduce the likelihood that the animal experiences a clinically-evident infection compared to an animal to which the composition is not administered. Methods for determining whether an infection is caused by a gram positive microbe are routine and known in the art, as are methods for determining whether the infection has decreased.

In another aspect, the present invention is directed to methods for treating one or more symptoms or clinical signs of certain conditions in an animal that may be caused by infection by a gram positive microbe, preferably by a member of the family Micrococcaceae, preferably, *Staphylococcus* spp., more preferably, *S. aureus*; members of the family Streptoococcaceae, preferably, *Streptococcus pyogenes, Streptococcus pneumoniae, Streptococcus agalactiae, Streptococcus uberis, Streptococcus bovis, Streptococcus equi,* or *Streptococcus dysgalactiae; Bacillus* spp., *Clostridium* spp., *Corynebacterium* spp., *Enterococcus* spp., *Erysipelothrix* spp., *Kytococcus* spp., *Listeria* spp., *Micrococcus* spp., *Mycobacterium* spp., and *Erysipelothrix* spp. The method includes administering an effective amount of a composition of the present invention to an animal having or at risk of having a condition, or exhibiting symptoms and/or clinical signs of a condition, and determining whether at least one symptom and/or clinical sign of the condition is changed, preferably, reduced. Examples of conditions and/or clinical signs caused by microbial infections include, for instance, mastitis, septicemia, pneumonia, meningoencephalitis, lymphangitis, dermatitis, genital tract infections, strangles, metritis, perinatal disease, pituitary abscesses, arthritis, bursitis, orchitis, cystitis and pyelonephritis, caseous lymphadenitis, tuberculosis, ulcerative lymphangitis, listeriosis, erysipelas, laminitis, anthrax, tyzzer's disease, tetanus, botulism, enteritis, malignant edema, braxy, bacillary hemoglobinuria, enterotoxemia, necrotic skin lesions, and nosocomial infections. Examples of conditions caused by *S. aureus* also include, for instance, botryomycosis in horses, purulent synovitis and osteomyelitis in poultry, abortions in swine, and tick pyemia in lambs. Examples of conditions caused by *Streptococcus* spp. also include, for instance, sore throat, scarlet fever, impetigo, ulcerative endocarditis, rheumatic fever and post streptococcal glomerulonephritis cervicitis in humans, cervicitis in equine and swine, and meningitis and jowl abscesses in swine.

Treatment of symptoms and/or clinical signs associated with these conditions can be prophylactic or, alternatively, can be initiated after the development of a condition described herein. As used herein, the term "symptom" refers to subjective evidence of disease or condition experienced by the patient and caused by infection by a microbe. As used herein, the term "clinical sign" or, simply, "sign" refers to objective evidence of disease or condition caused by infection by a microbe. Symptoms and/or clinical signs associated with conditions referred to herein and the evaluations of such symptoms are routine and known in the art. Treatment that is prophylactic, for instance, initiated before a subject manifests symptoms or signs of a condition caused by a microbe, is referred to herein as treatment of a subject that is "at risk" of developing the condition. Thus, typically, an animal "at risk" of developing a condition is an animal present in an area where animals having the condition have been diagnosed and/or is likely to be exposed to a microbe causing the condition even if the animal has not yet manifested symptoms or signs of any condition caused by the microbe. Accordingly, administration of a composition can be performed before, during, or after the occurrence of the conditions described herein. Treatment initiated after the development of a condition may result in decreasing the severity of the symptoms of one of the conditions, or completely removing the symptoms. In this aspect of the invention, an "effective amount" is an amount effective to prevent the manifestation of symptoms of a disease, decrease the severity of the symptoms of a disease, and/or completely remove the symptoms. The successful treatment of a gram positive microbial infection in an animal is disclosed in Example 5, which demonstrates the protection against disease caused by *S. aureus* in mouse models by administering a composition of the present invention. These mouse models are a commonly accepted model for the study of human disease caused by these microbes. The successful treatment of a gram positive microbial infection in an animal is also disclosed in Examples 10 to 12, which demonstrate that administering a composition of the present invention provides protection against disease caused by *S. aureus* in cows.

The present invention also provides methods for decreasing colonization by gram positive microbes, for instance blocking the attachment sites of gram positive microbe, including tissues of the skeletal system (for instance, bones, cartilage, tendons and ligaments), muscular system, (for instance, skeletal and smooth muscles), circulatory system (for instance, heart, blood vessels, capillaries and blood), nervous system (for instance, brain, spinal cord, and peripheral nerves), respiratory system (for instance, nose, trachea lungs, bronchi, bronchioceles, alveoli), digestive system (for instance, mouth, salivary glands oesophagus liver stomach large and small intestine), excretory system (for instance, kidneys, ureters, bladder and urethra), endocrine system (for instance, hypothalamus, pituitary, thyroid, pancreas and adrenal glands), reproductive system (for instance, ovaries, oviduct, uterus, vagina, mammary glands, testes, and seminal vesicles), lymphatic/immune systems (for instance, lymph, lymph nodes and vessels, mononuclear or white blood cells, such as macrophages, neutrophils, monocytes, eosinophils, basophils, and lymphocytes, including T cells and B cells), and specific cell lineages (for instance, precursor cells, epithelial cells, stem cells), and the like. Preferably, the gram positive microbe is a member of the family Micrococcaceae, preferably, *Staphylococcus* spp., more preferably, *S. aureus*; a member of the family Streptoococcaceae, preferably, *Streptococcus pyogenes, Streptococcus pneumoniae, Streptococcus agalactiae, Streptococcus uberis, Streptococcus bovis, Streptococcus equi,* or *Streptococcus dysgalactiae; Bacillus* spp., *Clostridium* spp., *Corynebacterium* spp., *Enterococus* spp., *Erysipelothrix* spp., *Kytococcus* spp., *Listeria* spp., *Micrococcus* spp., *Mycobacterium* spp., and *Erysipelothrix* spp.

Decreasing colonization in an animal may be performed prophylactically or, alternatively, can be initiated after the animal is colonized by the microbe. Treatment that is prophylactic—e.g., initiated before a subject is colonized by a microbe or while any colonization remains undetected—is referred to herein as treatment of a subject that is "at risk" of colonization by the microbe. Thus, typically, an animal "at risk" of colonization by a microbe is an animal present in an area where animals have been identified as colonized by the microbe and/or is likely to be exposed to the microbe even if the animal has not yet manifested any detectable indication of colonization by the microbe and regardless of whether the animal may harbor a subcolonization number of the microbe. Accordingly, administration of a composition can be performed before, during, or after the animal has first contact with the microbe. Treatment initiated after the animal's first contact with the microbe may result in decreasing the extent of colonization by the microbe, completely removing the microbe, and/or decreasing the likelihood that the animal becomes colonized by the microbe compared to an animal to which the composition is not administered. Thus, the method includes administering an effective amount of a composition of the present invention to an animal colonized by, or at risk of being colonized by, a gram positive microbe. In this aspect of the invention, an "effective amount" is an amount sufficient to decrease colonization of the animal by the microbe, where decreasing colonization refers to one or more of: decreasing the extent of colonization by the microbe, completely removing the microbe, and/or decreasing the likelihood that the animal becomes colonized by the microbe compared to an animal to which the composition is not administered. Methods for evaluating the colonization of an animal by a microbe are routine and known in the art. For instance, colonization of an animal's intestinal tract by a microbe can be determined by measuring the presence of the microbe in the animal's feces. It is expected that decreasing the colonization of an animal by a microbe will reduce transmission of the microbe to humans.

A composition of the invention can be used to provide for active or passive immunization against bacterial infection. Generally, the composition can be administered to an animal to provide active immunization. However, the composition can also be used to induce production of immune products, such as antibodies, which can be collected from the producing animal and administered to another animal to provide passive immunity. Immune components, such as antibodies, can be collected to prepare compositions (preferably containing antibody) from serum, plasma, blood, colostrum, etc. for passive immunization therapies. Antibody compositions including monoclonal antibodies and/or anti-idiotypes can also be prepared using known methods. Chimeric antibodies include human-derived constant regions of both heavy and light chains and murine-derived variable regions that are antigen-specific (Morrison et al., Proc. Natl. Acad. Sci. USA, 1984, 81(21):6851-5; LoBuglio et al., Proc. Natl. Acad. Sci. USA, 1989, 86(11):4220-4; Boulianne et al., Nature, 1984, 312(5995):643-6.). Humanized antibodies substitute the murine constant and framework (FR) (of the variable region) with the human counterparts (Jones et al., Nature, 1986, 321(6069):522-5; Riechmann et al., Nature, 1988, 332(6162):323-7; Verhoeyen et al., Science, 1988, 239(4847):1534-6; Queen et al., Proc. Natl. Acad. Sci. USA, 1989, 86(24):10029-33; Daugherty et al., Nucleic Acids Res., 1991, 19(9): 2471-6.). Alternatively, certain mouse strains can be used that have been genetically engineered to produce antibodies that are almost completely of human origin; following immunization the B cells of these mice are harvested and immortalized for the production of human monoclonal antibodies (Bruggeman and Taussig, Curr. Opin. Biotechnol., 1997, 8(4):455-8; Lonberg and Huszar, Int. Rev. Immunol., 1995; 13(1):65-93; Lonberg et al., Nature, 1994, 368:856-9; Taylor et al., Nucleic Acids Res., 1992, 20:6287-95.). Passive antibody compositions and fragments thereof, e.g., scFv, Fab, F(ab')$_2$ or Fv or other modified forms thereof, may be administered to a recipient in the form of serum, plasma, blood, colostrum, and the like. However, the antibodies may also be isolated from serum, plasma, blood, colostrum, and the like, using known methods for later use in a concentrated or reconstituted form such as, for instance, lavage solutions, impregnated dressings and/or topical agents and the like. Passive immunization preparations may be particularly advantageous for the treatment of acute systemic illness, or passive immunization of young animals that failed to receive adequate levels of passive immunity through maternal colostrum. Antibodies useful for passive immunization may also be useful to conjugate to various drugs or antibiotics that could be directly targeted to bacteria expressing during a systemic or localized infection a polypeptide of the present invention or a polypeptide having an epitope structurally related to an epitope present on a polypeptide of the present invention.

Animal models, in particular mouse models, are available for experimentally evaluating the compositions of the present invention. These mouse models are commonly accepted models for the study of human disease caused by members of the genus *Staphylococcus*, and *S. aureus* in particular. In those cases where a member of the genus *Staphylococcus* causes disease in an animal, for instance a cow, the natural host can be used to experimentally evaluate the compositions of the present invention.

However, protection in a mouse model is not the only way to assess whether a composition can confer protection to an animal against infection by a *Staphylococcus* spp. The adaptive immune response consists of two primary divisions: the humoral (antibody) response and the cellular (T cell) response. Following infection by a bacterial pathogen, dendritic cells at the infection site encounter microbial antigens and produce signaling molecules such as, for example, surface receptors and cytokines in response to conserved molecular patterns associated with the specific bacterium. These signals are shaped by the nature of the pathogen and ideally lead to the appropriate antibody and T cell responses that protect the host from disease. While some bacterial diseases are controlled primarily through antibody functions, others require T cell responses or both antibody and T cell responses for protection. The goal of vaccine biology is to identify the immune responses that provide protection and then design a vaccine to reproduce one or more of these responses in humans.

Antibodies can have many different functions in the conferring protection against infection such as, for example, complement fixation, opsonization, neutralization, and/or agglutination. Moreover, some subclasses of antibodies are better than others at specific functions; for example, for complement fixation the following hierarchy exists for human IgG subclasses: IgG3>IgG1>IgG2>IgG4).

Antibody immunological functions can be studied in a variety of ways. For instance, Western blots are used to identify antigen-specific binding based on size of separated proteins, while the standard enzyme-linked immunosorbant assay (ELISA) is used to produce quantitative information about antibody titers within serum. Antibody surface binding studies are used to determine whether antibody in serum are able to recognize antigens on the surface of intact bacteria, an important indicator of whether the antibodies have the potential to work in vivo. Thus, one skilled in the art recognizes that antibody binding assays such as a Western blot, ELISA (e.g., using human antisera), and/or surface binding correlate positively with the specifically-bound antigens providing immunological activity against infection by *Staphylococcus* spp. (Vytvytska et al. 2002, *Proteomics* 2:580-590; Kuklin et al. 2006, *Infect. Immun.* 74(4):2215-2223; Dryla et al. 2005, *Clin. Diag. Lab. Immunol.* 12(3): 387-398). However, one skilled in the art further recognizes that a lack of antibody binding in an assay such as, for example, a Western blot, ELISA, or surface binding assay does not mean that the assayed antigen fails to provide immunological activity against infection by *Staphylococcus* spp. (Kim H K et al. IsdA and IsdB antibodies protect mice against *Staphylococcus aureus* abcess formation and lethal challenge. Vaccine (2010), doi:10.1016/j.vaccine.2010.02.097).

FIG. 202 shows that convalescent mouse serum binds to at least recombinantly-produced MntC (SEQ ID NO:419), recombinantly-produced SYN2 (SEQ ID NO:386), recombinantly-produced SirA (SEQ ID NO:375), and recombinantly-produced Opp1A (SEQ ID NO:364), indicating that each of the bound recombinantly-produced polypeptides can induce immunological activity against infection by *Staphylococcus* spp.

FIG. 204 shows that convalescent human serum binds to recombinantly-produced NIB (SEQ ID NO:353), recombinantly-produced Opp1A (SEQ ID NO:364), recombinantly-produced SirA (SEQ ID NO:375), recombinantly-produced SYN2 (SEQ ID NO:386), recombinantly-produced FhuD (SEQ ID NO:397), recombinantly-produced SYN1 (SEQ ID NO:408), and recombinantly-produced MntC (SEQ ID NO:419), indicating that each of the recombinantly-produced polypeptides can induce immunological activity against infection by *Staphylococcus* spp.

FIG. 205 shows that antibody raised against recombinantly-produced FhuD (SEQ ID NO:397), recombinantly-produced Opp1A (SEQ ID NO:364), and recombinantly-produced PflB (SEQ ID NO:353) binds to the surface of *Staphylococcus* spp. cells, indicating that each of the polypeptide targets of the cell-binding antibody can induce immunological activity against infection by *Staphylococcus* spp.

Techniques such as opsonophagocytosis assays (OPA), in which antibody and complement-bound bacteria are combined with human or mouse phagocytes to determine levels of bacterial killing, are useful for studying antibody function. Positive OPA results correlate with vaccine-induced protection in a mouse model. (Stranger-Jones et al. 2006, *Proc. Natl. Acad. Sci.* 103(45):16942-16947). A similar oxidative burst assay can be used to assess the level of reactive oxygen species (ROS) by fresh human or mouse neutrophils following interaction with antibody and complement-bound bacteria.

In some cases, one can determine that a candidate polypeptide possesses cell-mediated immunological activity and, therefore, the candidate polypeptide may exhibit immunological activity in the absence of inducing the production of antibodies. (Spellberg et al. 2008, *Infect. Immun.* 76(10): 4575-4580). Cytotoxic or CD8 T cells primarily kill infected cells directly through various effector mechanisms, while helper CD4 T cells function to provide important signaling in the way of cytokines. These T cell classes can be further subdivided based on the cytokines they produce, and different subclasses are effective against different bacterial pathogens. T cells are often studied by assessing their phenotypes with flow cytometry, where antibodies are used to visualize the levels of specific surface markers that enable classification of the T cells as, for example, a recently activated $CD4^+$ T cell, a memory $CD8^+$ T cell, etc. In addition, cytokines and other products of T cells can be studied by isolating the T cells from lymphoid tissue and restimulating them with cognate antigen. Following antigen stimulation the T cells produce cytokines that may be visualized by, for example, intracellular cytokine staining coupled with flow cytometry, or collecting the cell supernatants and using Luminex bead technology to measure 15-25 cytokines simultaneously.

FIG. 206 shows that a composition (rSIRP7) that includes recombinantly-produced PflB (SEQ ID NO:353), recombinantly-produced Opp1A (SEQ ID NO:364), recombinantly-produced SirA (SEQ ID NO:375), recombinantly-produced SYN2 (SEQ ID NO:386), recombinantly-produced FhuD (SEQ ID NO:397), recombinantly-produced SYN1 (SEQ ID NO:408), and recombinantly-produced MntC (SEQ ID NO:419) induces a cytokine profile similar to the cytokine profile induced by the SIRP extract demonstrated to provide immunological activity against infection by *Staphylococcus* spp. The rSIRP7 composition induced the production of, for example, IL-2, IL-6, IL-17, IFN-γ, MIP-2, and GM-CSF.

Thus, in addition to mouse models, those of ordinary skill in the art recognize that immunological activity commensurate with the methods described herein may correlate with any one or more of the following: Western blot data showing that serum from animals exposed to a *Syaphylococcus* spp. contains antibody that specifically binds to a candidate polypeptide, cell surface binding assays demonstrating that antibody that specifically binds to a candidate polypeptide specifically binds to a *Staphylococcus* spp., opsonophagocytosis data, and cytokine induction.

Another aspect of the present invention provides methods for detecting antibody that specifically binds polypeptides of the present invention. These methods are useful in, for instance, detecting whether an animal has antibody that specifically binds polypeptides of the present invention, and diagnosing whether an animal may have a condition caused by a microbe expressing polypeptides described herein, or expressing polypeptides that share epitopes with the polypeptides described herein. Such diagnostic systems may be in kit form. The methods include contacting an antibody with a preparation that includes a polypeptide of the present invention to result in a mixture. The antibody may be present in a biological sample, for instance, blood, milk, or colostrum. The method further includes incubating the mixture under conditions to allow the antibody to specifically bind the polypeptide to form a polypeptide:antibody complex. As used herein, the term "polypeptide:antibody complex" refers to the complex that results when an antibody specifically binds to a polypeptide. The preparation that includes the polypeptides of the present invention may also include reagents, for instance a buffer, that provide conditions appropriate for the formation of the polypeptide:antibody complex. The polypeptide:antibody complex is then detected. The detection of antibodies is known in the art and can include, for instance, immunofluorescence or peroxidase. The methods for detecting the presence of antibodies that specifically bind to polypeptides of the present invention can be used in various formats that have been used to detect antibody, including radioimmunoassay and enzyme-linked immunosorbent assay.

The present invention also provides a kit for detecting antibody that specifically binds polypeptides of the present invention. The antibody detected may be obtained from an animal suspected to have an infection caused by a gram positive microbe, more preferably, a member of the family Micrococcaceae, preferably, *Staphylococcus* spp., more preferably, *S. aureus; Streptococcus* spp., *Bacillus* spp., *Clostridium* spp., *Corynebacterium* spp., *Enterococus* spp., *Erysipelothrix* spp., *Kytococcus* spp., *Listeria* spp., *Micrococcus* spp., *Mycobacterium* spp., and *Erysipelothrix* spp.

The kit includes at least one of the polypeptides of the present invention (e.g., one, at least two, at least three, etc.), in a suitable packaging material in an amount sufficient for at least one assay. Optionally, other reagents such as buffers and solutions needed to practice the invention are also included. For instance, a kit may also include a reagent to permit detection of an antibody that specifically binds to a polypeptide of the present invention, such as a detectably labeled secondary antibody designed to specifically bind to an antibody obtained from an animal. Instructions for use of the packaged polypeptides are also typically included. As used herein, the phrase "packaging material" refers to one or more physical structures used to house the contents of the kit. The packaging material is constructed by well known methods, generally to provide a sterile, contaminant-free environment. The packaging material may have a label which indicates that the polypeptides can be used for detecting antibody that specifically binds polypeptides of the present invention. In addition, the packaging material contains instructions indicating how the materials within the kit are employed to detect the antibody. As used herein, the term "package" refers to a container such as glass, plastic, paper, foil, and the like, capable of holding within fixed limits the polypeptides, and other reagents, for instance a secondary antibody. Thus, for example, a package can be a microtiter plate well to which microgram quantities of polypeptides have been affixed. A package can also contain a secondary antibody. "Instructions for use" typically include a tangible expression describing the reagent concentration or at least one assay method parameter, such as the relative amounts of reagent and sample to be admixed, maintenance time periods for reagent/sample admixtures, temperature, buffer conditions, and the like.

The present invention is illustrated by the following examples. It is to be understood that the particular examples, materials, amounts, and procedures are to be interpreted broadly in accordance with the scope and spirit of the invention as set forth herein.

EXAMPLES

Example 1

Preparation of Iron Regulated Proteins Laboratory Scale

Compositions derived from different strains of *Staphylococcus aureus* including novel proteins expressed under iron-restriction and/or other degrees of metal ion chelation were evaluated for efficacy against a virulent challenge in mice. The efficacy of the composition was evaluated by collecting data on the following parameters (1) the efficacy of each composition to provide homologous and heterologous protection against a live virulent challenge in mice, (2) the efficacy of each composition to reduce necrotic skin lesions, and (3) the efficacy of compositions derived from *Staphylococcus* grown in replete and deplete iron conditions to provide protection.

The *Staphylococcus aureus* strains evaluated in this study originated from three animal species; avian, human and bovine. The avian isolate SAAV1 was a field isolate originating from a flock of diseased turkeys having a high degree of osteomyelitis and synovitis. The bovine isolates (strain 1477 and strain 2176) were isolated from two different commercial dairy herds having a high incidence of clinical mastitis. The human isolate was obtained from the ATCC (strain 19636), and originated from a patient having clinical osteomyelitis.

Master seed stocks of each isolate were prepared by inoculating the appropriate isolate into 200 ml of Tryptic Soy Broth (TSB, Difco Laboratories, Detroit, Mich.) containing 300 µM 2,2-dipyridyl (Sigma-Aldrich St. Louis, Mo.). The culture was grown while stirring at 200 rpm for 6 hours at 37° C., and collected by centrifugation at 10,000× g. The bacterial pellet was re-suspended into 100 ml TSB broth containing 20% glycerol, and sterilely dispensed into 2 ml cryogenic vials (1 ml per vial) and stored at −90° C. until use.

Each master seed stock was expanded into a working seed. One vial of each master seed isolate was inoculated into 200 ml of Tryptic Soy Broth (TSB, Difco Laboratories, Detroit, Mich.) containing 1000 µM 2,2-dipyridyl (Sigma-Aldrich St. Louis, Mo.). The culture was grown while stirring at 200 rpm for 6 hours at 37° C., and collected by centrifugation at 10,000×g. The bacterial pellet was resuspended into 100 ml TSB broth containing 20% glycerol, and sterilely dispensed into 2 ml cryogenic vials (1 ml per vial) and stored at −90° C. until use. The working seed was used for the production of compositions enriched with iron-regulated membrane proteins, including iron-regulated membrane proteins.

All strains were adapted to grow in highly iron-depleted media (i.e., media containing very low levels of free iron). This was accomplished by subculturing the bacteria in TSB containing increasing concentrations of 2,2-dipyridyl (from 300 to 1600 µM).

Proteins were prepared from bacteria as follows. The bacteria were grown from frozen working seed stocks by subculturing into 25 ml of iron-deplete media (containing 1000 µM 2,2'-dyipyridyl) and iron-replete media, then incubated at 37° C. while shaking at 400 rpm. Following 12 hours of incubation, 5 ml of each culture was transferred into 500 ml of iron-deplete or iron-replete media pre-incubated at 37° C. Cultures were incubated for 8 hours at 37° C. while shaking at 100 rpm, then cells were pelleted by centrifugation at 10,000×g for 20 minutes. Bacterial pellets were resuspended in 100 ml of sterile physiological saline and centrifuged at 10,000×g for 10 minutes. Pellets were then resuspended in 45 ml of Tris-buffered saline, pH 7.2 (TBS; 25 mM Tris, 150 mM NaCl) and the resulting bacterial suspensions were dispensed as 9-ml aliquots into 5 individual tubes. One milliliter of TBS containing 50 units of lysostaphin (Sigma, St. Louis, Mo.) was added to each tube to give a final volume of 5 units/ml. Following incubation at 37° C. for 30 minutes while shaking at 200 rpm, 1 ml of TBS containing 0.1 mg of lysozyme (Sigma) was added to each tube. The bacterial suspensions were then incubated for an additional 45 minutes while shaking at 200 rpm. Next, suspensions were centrifuged at 3050×g for 12 minutes at 4° C. to pellet large cellular debris. The supernatants were collected by aspiration without disturbing the pellet. The supernatant was then centrifuged at 39,000×g for 2.5 hours. The resulting pellets containing the proteins were resuspended into 200 µl, Tris buffer, pH 7.2, without saline. The protein solution for each isolate were combined for a total volume of 1 ml and stored at −90° C.

The protein-enriched extracts derived from *S. aureus* were size-fractionated on SDS-PAGE gels using a 4% stacking gel and 10% resolving gel. Samples for electrophoresis were prepared by combining 10 μl of sample with 30 μl of SDS reducing sample buffer (62.5 mM Tris-HCL pH 6.8, 20% glycerol, 2% SDS, 5% β-mercaptoethanol) and boiled for 4 minutes. Samples were electrophoresed at 18 mA constant current for 5 hours at 4° C. using a PROTEAN II xi cell power supply (BioRad Laboratories, Richmond, Calif., model 1000/500). The molecular weight of each individual protein as visually seen in the SDS-PAGE gel was estimated using a GS-800 densitometer (BioRad) using a broad range molecular weight marker as a reference standard (BioRad).

The SDS-PAGE patterns of the proteins from each isolate when grown in the presence of 1600 μM dipyridyl showed a very different protein expression pattern compared to the same strain when grown in the presence of 300 μM dipyridyl. For instance, when grown in 300 μM dipyridyl isolate SAAV1 resulted in metal-regulated proteins of 90 kDa, 84 kDa, 72 kDa, 66 kDa, 36 kDa, 32 kDa, and 22 kDa, while growth in 1600 μM dipyridyl resulted in metal-regulated proteins of 87.73 kDa, 54.53 kDa, 38.42 kDa, 37.37 kDa, 35.70 kDa, 34.91 kDa, and 33.0 kDa. Likewise, when grown in 300 μM dipyridyl isolate 19636 resulted in proteins of 42 kDa and 36 kDa, while growth in 1600 μM dipyridyl resulted in metal-regulated proteins of 87.73 kDa, 54.53 kDa, 38.42 kDa, 37.37 kDa, 35.70 kDa, 34.91 kDa, and 33.0 kDa. All conditions, including growth in iron-replete media, resulted in the expression of the following proteins that were presumably not metal-regulated: 150 kDa, 132 kDa, 120 kDa, 75 kDa, 58 kDa, 50 kDa, 44 kDa 43 kDa 41 kDa, and 40 kDa.

Furthermore, growth of the different strains of *S. aureus* in 1600 dipyridyl resulted in similar protein expression patterns. The compositions enriched in iron-regulated membrane proteins from the avian isolate (SAAV1) included proteins with molecular weights of 87.73 kDa, 54.53 kDa, 38.42 kDa, 37.37 kDa, 35.70 kDa, 34.91 kDa, and 33.0 kDa. The molecular weights of the proteins from the ATCC isolate 19636 were essentially identical to those from the avian isolate. Both bovine isolates, when grown with 1600 μM 2,2-dipyridyl, expressed similar banding profiles as the avian and ATCC isolates for the majority of the proteins (87.73 kDa, 54.53 kDa, 37.7 kDa, 35.70 kDa, 34.91 kDa, and 33.0 kDa). However, neither of the bovine isolates produced the 38.42 kDa protein seen with the avian and ATCC isolates, and the bovine isolates expressed three proteins (80.46 kDa, 65.08 kDa, and 31.83 kDa) not observed with the avian and ATCC strains (see FIG. 1 and Table 7). All conditions resulted in the expression of the following proteins that were not metal-regulated: 150 kDa, 132 kDa, 120 kDa, 75 kDa, 58 kDa, 50 kDa, 44 kDa, 43 kDa, 41 kDa, and 40 kDa.

TABLE 7

Molecular weights of metal-regulated polypeptides obtained from *Staphylococcus aureus* isolates.

| Avian SAAV1 | Human 19636 | Bovine 1477 | Bovine 2176 |
|---|---|---|---|
| 87.73 | 87.73 | 87.73 | 87.73 |
| — | — | 80.46 | 80.46 |
| — | — | 65.08 | 65.08 |
| 54.53 | 54.53 | 54.53 | 54.53 |
| 38.42 | 38.42 | — | — |
| 37.37 | 37.37 | 37.37 | 37.37 |
| 35.70 | 35.70 | 35.70 | 35.70 |
| 34.91 | 34.91 | 34.91 | 34.91 |
| 33.0 | 33.0 | 33.0 | 33.0 |
| | | 31.83 | 31.83 |

Interestingly, there was no difference in the protein profiles as examined by SDS-PAGE between the clarified supernatant and the bacterial pellet after treating the bacteria with lysostaphin/lysozyme. Both the extracted bacterial pellet and the supernatant had exactly the same protein profiles as examined by SDS-PAGE. This same observation was also seen when disrupting the bacterial cells using an AVESTIN homogenizer at 30,000 psi. The resultant bacterial pellet, after slow speed centrifugation was identical in its protein profile as compared to the clarified supernatant after high speed centrifugation at 30,000×g for 2.0 hours at 4° C.

Example 2

Preparation of the Immunizing Compositions Derived from *Staphylococcus aureus*

The proteins from the human isolate ATCC 19636 and the bovine isolate 1477, grown in iron-deplete conditions and prepared as described in Example 1, were used to formulate two vaccine compositions. The proteins from the ATCC isolate had molecular weights of 87.73 kDa, 54.53 kDa, 38.42 kDa, 37.37 kDa, 35.70 kDa, 34.91 kDa, and 33.0 kDa, while the bovine isolate expressed proteins having molecular weights 87.73 kDa, 80.46 kDa, 65.08 kDa, 54.53 kDa, 37.37 kDa, 35.70 kDa, 34.91 kDa, 33.0 kDa, and 31.83. Each composition also contained the following proteins that were not metal-regulated: 150 kDa, 132 kDa, 120 kDa, 75 kDa, 58 kDa, 50 kDa, 44 kDa, 43 kDa, 41 kDa, and 40 kDa. Stock vaccines were prepared from the two strains by emulsifying each aqueous protein suspension (500 μg total protein/ml) into a commercial adjuvant (EMULSIGEN, MVP Laboratories, Ralston, Nebr.) using an IKA ULTRA TURRAX T-50 homogenizing vessel (IKA, Cincinnati, Ohio) to give a final dose of 50 μg total protein in a 0.1 ml injectable volume with an adjuvant concentration of 22.5% vol/vol. As a control vaccination, a protein composition was prepared from the bovine isolate 1477 grown under iron-replete conditions (TSB supplemented with 300 μM ferric chloride) as described in Example 1. A placebo vaccine was prepared by substituting physiological saline for the aqueous protein suspension in the above protocol.

Example 3

Mouse Vaccination

Seventy (N=70) female CF-1 mice obtained from Harlan Breeding Laboratories (Indianapolis, Ind.) weighing 16-22 grams were equally distributed into 7 groups (10 mice/group). Mice were housed in polycarbonate mouse cages (Ancore Corporation, Bellmore, N.Y.). A single cage was used for each treatment group and food and water was supplied ad libitum to all mice. All mice were vaccinated intraperitoneally with 0.1 ml of the appropriate composition two times at 14 day intervals as follows:

Group-1: Placebo-Vaccinated
Group-2: Vaccinated with ATCC 19636 proteins expressed under iron-restriction.
Group-3: Placebo-Vaccinated
Group-4: Vaccinated with Bovine 1477 proteins expressed under iron-restriction.
Group-5: Vaccinated with Bovine 1477 proteins expressed under iron-restriction.
Group-6: Vaccinated with ATCC 19636 proteins expressed under iron-restriction.
Group-7: Bovine 1477 FeCl$_3$-Vaccinated, where "Bovine 1477 FeCl$_3$" refers to proteins obtained from Bovine 1477 grown in TSB supplemented with 300 µM ferric chloride.

Example 4

Preparation of Challenge Organism

The previously described *Staphylococcus aureus* strains ATCC 19636 and strain 1477 were used as challenge organisms. Briefly, the isolates from frozen stocks (previously described) were streaked onto blood agar plates and incubated at 37° C. for 18 hours. A single colony of each isolate was subcultured into 50 ml Tryptic Soy Broth (Difco) containing 1600 µM 2,2' dipyridyl. The cultures were incubated at 37° C. for 6 hours while rotating at 200 rpm, then centrifuged at 10,000×g for 10 minutes at 4° C. to pellet the bacteria. The bacterial pellets were washed twice by centrifugation in TBS at 4° C. The final pellets were resuspended in TBS to an optical density of 42% Transmittance (T) at 562 nm in a volume of approximately 25 ml of TBS and used for challenge. Just prior to challenge, 1 ml of these bacterial suspensions was serially diluted and plated on agar to enumerate the number of colony-forming units (CFU) per mouse dose.

Example 5

Challenge

Fourteen days after the second vaccination, mice in all groups (1-7) were subcutaneously challenged in the back of the neck with 0.1 ml of the appropriate organism. The seven groups of mice were challenged as follows:

Group-1 (Placebo-Vaccinated): Challenged with ATCC 19636
Group-2 (Vaccinated with ATCC 19636 proteins expressed under iron-restriction): Challenged with ATCC 19636
Group-3 (Placebo-Vaccinated): Challenged with Bovine 1477
Group-4 (Vaccinated Bovine 1477 proteins expressed under iron-restriction): Challenged with Bovine 1477
Group-5 (Vaccinated Bovine 1477 proteins expressed under iron-restriction): Challenged with ATCC 19636
Group-6 (Vaccinated ATCC 19636 proteins expressed under iron-restriction): Challenged with Bovine 1477
Group-7 (Bovine 1477 FeCl$_3$-Vaccinated): Challenged with Bovine 1477

As determined by the enumeration protocol described in Example 4, the concentration of *S. aureus* 19636 used for challenge was 1.35×10$^8$ CFU per mouse dose, and the concentration of *S. aureus* 1477 used for challenge was 1.65×10$^8$ colony CFU per mouse dose. Morbidity, mortality and gross pathology were recorded daily for 7 days after challenge.

Figure 2:
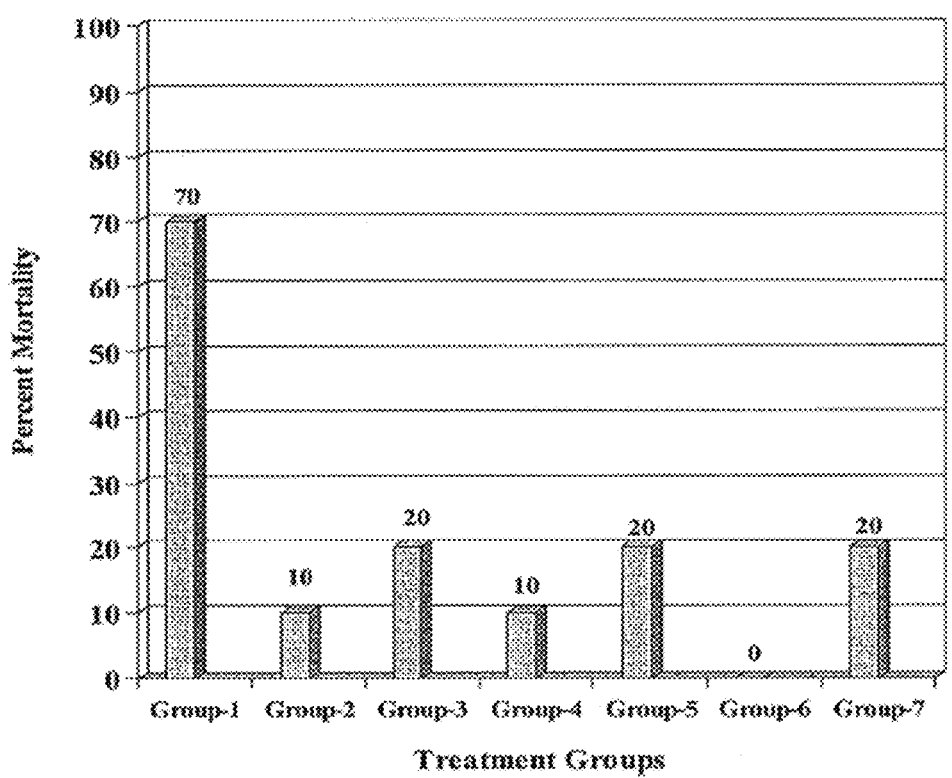
Figure 3:
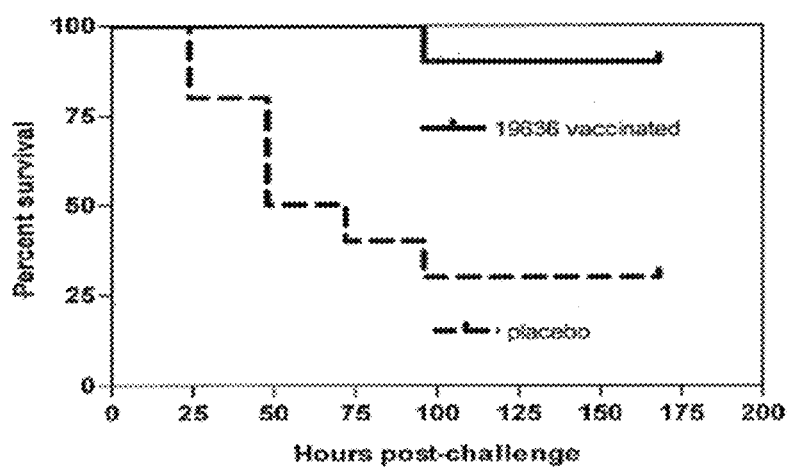

When comparing the mice challenged with the ATCC 19636 isolate, 70% of the placebo-vaccinated Group 1 mice died within 7 days of challenge (Table 8 and FIG. 2). This demonstrated that strain 19636 caused a high rate of mortality in mice at the dose level administered. In contrast to the mice in Group 1, only 10% of the mice in Group 2 died within 7 days post-challenge. These results illustrated that the mice challenged with strain 19636 were significantly protected by vaccination with the 19636 composition (p=0.020, Fischer's Exact test). Furthermore, a Kaplan-Meier analysis of the time-to-death data indicated that the vaccine afforded significant (p=0.0042, logrank test) protection against homologous challenge (FIG. 3). In addition, only 20% of the mice in Group 5 died within 7 days of challenge, indicating that the bovine 1477 composition offered significant protection against challenge with the ATCC 19636 strain (p=0.015 logrank test for mortality). When the data was analyzed by a Kaplan-Meier survival curve and logrank test (FIG. 4), the protection against mortality was determined to be significant (p=0.015 logrank test for mortality), indicating that the vaccine composition derived from strain 1477 provided heterologous protection against challenge with strain 19636.

TABLE 8

Mortality of Vaccinated and Non-Vaccinated Mice Following Challenge with *Staphylococcus aureus* (human ATCC isolate 19636 and bovine isolate 1477).

| Groups | # Mice | # Dead | Percent mortality (%) |
| --- | --- | --- | --- |
| Group-1* (Placebo, ATCC 19636 Chlg) | 10 | 7/10 | 70 |
| Group-2* (ATCC 19636, Homologous Chlg) | 10 | 1/10 | 10 |
| Group-3* (Placebo, Bovine 1477 Chlg) | 10 | 2/10 | 20 |
| Group-4* (Bovine 1477, Homologous Chlg) | 10 | 1/10 | 10 |
| Group-5* (Bovine 1477, Heterologous Chlg) | 10 | 2/10 | 20 |
| Group-6* (ATCC 19636, Heterologous Chlg) | 10 | 0/10 | 0 |
| Group-7* (Bovine 1477 FeCl$_3$, Bovine 1477 Chlg) | 10 | 2/10 | 20 |

*Group-1, (Placebo-Vaccinated/Challenged with ATCC 19636)
*Group-2 (Vaccinated with ATCC 19636 proteins expressed under iron-restriction/Challenged with ATCC 19636)
*Group-3 (Placebo-Vaccinated/Challenged with Bovine 1477)
*Group-4 (Vaccinated with Bovine 1477 proteins expressed under iron-restriction/Challenged with Bovine 1477)
*Group-5 (Vaccinated with Bovine 1477 proteins expressed under iron-restriction/Challenged with ATCC 19636)
*Group-6 (Vaccinated with ATCC 19636 proteins expressed under iron-restriction/Challenged with Bovine 1477)
*Group-7 (Bovine 1477 FeCl$_3$ -Vaccinated/Challenged with Bovine 1477)

When comparing the mice challenged with the bovine 1477 isolate, only 20% of the mice in the placebo-vaccinated group (Group 3) died within 7 days of challenge. However, challenge with the bovine 1477 isolate elicited the development of necrotic skin lesions on 6 (75%) of the surviving mice of Group 3. These lesions were measured and the average size of the lesions on the surviving mice was 18.5 mm (Table 9). In contrast, 20% of the Group 4 mice died within 7 days of challenge, but only three (38%) of the surviving mice developed lesions (average diameter, 2.7 mm). These results indicate that the bovine 1477 composition offered significant homologous protection against development of lesions in the mice challenged with the bovine strain 1477 (p=0.009, Student's t-test). In addition, vaccination with the ATCC 19636 composition protected against challenge with strain 1477, since no mice died in Group 6 and only three (30%) of the mice developed skin lesions (average diameter, 3.7 mm). Taken together, the reduced mortality and/or lesion development in the mice in Groups 5 and 6 demonstrate the significant cross-protective nature of the compositions derived from strains 19636 and 1477 (p=0.012, Student's t-test based on lesion size). In demonstration of the efficacy of the composition as compared to the non-iron regulated proteins, 20% of the mice in Group 7 died and 4 of the survivors developed skin lesions (average diameter, 15.8 mm). The mice of Group 7 demonstrated some degree of protection by vaccination with the proteins of the 1477 isolate since fewer mice developed lesions compared to the placebo-vaccinated Group 3. However, the skin lesions observed on the mice in group 7 were more frequent and of a larger diameter than the lesions on the mice of Group 4, indicating that, relative to proteins isolated from cells grown under iron-replete conditions, the proteins isolated from bacteria grown under iron restriction offered superior protection against an identical challenge.

The cross-protective nature of the proteins observed in the mouse challenge study is supported by the similar molecular weights of the proteins from the *S. aureus* strains described in Example 1 (FIG. 1). Although there were noticeable differences in the SDS-PAGE profile of the proteins from the bovine-derived isolates, specifically the absence of a 38.4 kDa protein and the presence of 3 additional proteins, the proteins from both strains 1477 and ATCC 19636 elicited heterologous protection. These results indicate that the similar proteins between strains 19636 and 1477 are likely responsible for the cross-protection observed in Groups 5 and 6. By contrast, the protein profiles from strain 1477 grown under iron-deplete and iron-replete conditions are observably different. Those proteins isolated under iron-depleted conditions are more protective when compared to the proteins isolated under iron-replete conditions, demonstrated by the reduction in lesion development among the mice of Group 4 compared to the mice of Group 7.

Example 6

In mammals, it has been shown that the response to tissue injury or bacterial infection results in an acute inflammatory response. This response increases capillary permeability and phagocytic infiltration resulting in the clinical signs recognized as inflammation; swelling, fever, pain and redness; if left uncontrolled, this may lead to death. The activation of humoral factors and the release of cytokines mediate systemic events collectively known as the acute phase protein response which results in a cascade of physiological and biochemical events. The duration of this response is directly related to the severity of the injury and magnitude of the systemic infection. It has been well-documented that during bacterial sepsis, major surgery, burns and other bodily trauma there is an alteration in the concentration of a number of metal ions in serum such as, iron, copper, and zinc. For instance, during the acute phase of an infection there is a decrease in plasma levels of iron and zinc and an increase in copper. The alteration of these trace metal ions in serum may directly affect the severity or progression of any bacterial infection.

In this study we examined the expression of proteins of *Staphylococcus aureus* under various conditions of metal ion restriction in order to mimic the expression of novel proteins that may be expressed during systemic invasion. The *Staphylococcus aureus* strains evaluated in this study originated from clinical samples of three different species of animal; avian (strain SAAV1), human (strain 19636), and bovine (strains 1477 and 2176). Briefly, cultures of each isolate were prepared from master seed stocks in 200 ml of Tryptic Soy Broth (TSB). Each culture was grown while stirring at 200 rpm for 6 hours at 37° C. Ten ml of each culture were transferred into 500 ml of deplete TSB containing one of four metal ion chelators; 2,2-dipyridyl (Dp), 2-pyridylmethyl-ethylene diamine (TPEN), catechin, and naringenin (all obtained from Sigma, St. Louis, Mo.). In addition each culture was also grown in cation-replete media containing ferric chloride, zinc chloride and/or copper chloride prepared at 300 µM concentrations. The metal ion

TABLE 9

The Induction of Necrotic Lesions in Mice Seven Days Post-Challenge with *Staphylococcus aureus* (ATCC Isolate 19636 and/or Bovine Isolate 1477)

| Group-1 | Group-2 | Group-3 | Group-4 | Group-5 | Group-6 | Group-7 |
|---------|---------|---------|---------|---------|---------|---------|
| Lesion diameter (millimeter) per mouse | | | | | | |
| No lesion | No lesion | 26 | 5 | 5 | 5 | 25 |
| No lesion | No lesion | 25 | 2 | No lesion | 5 | 25 |
| No lesion | No lesion | 24 | 1 | No lesion | 1 | 10 |
| Dead | No lesion | 24 | No lesion | No lesion | No lesion | 3 |
| Dead | No lesion | 7 | No lesion | No lesion | No lesion | No lesion |
| Dead | No lesion | 5 | No lesion | No lesion | No lesion | No lesion |
| Dead | No lesion | No lesion | No lesion | No lesion | No lesion | No lesion |
| Dead | No lesion | No lesion | No lesion | No lesion | No lesion | No lesion |
| Dead | No lesion | Dead | No lesion | Dead | No lesion | Dead |
| Dead | Dead | Dead | Dead | Dead | No lesion | Dead |
| Average lesion diameter (mm) among surviving mice | | | | | | |
| 0 | 0 | 18.5 | 2.7 | 5 | 3.7 | 15.8 |

*Group-1, (Placebo -Vaccinated/Challenged ATCC 19636)
*Group-2 (Vaccinated with ATCC 19636 proteins expressed under iron-restriction/Challenged ATCC 19636)
*Group-3 (Placebo -Vaccinated/Challenged Bovine 1477)
*Group-4 (Vaccinated with Bovine 1477 proteins expressed under iron-restriction/Challenged Bovine 1477)
*Group-5 (Vaccinated with Bovine 1477 proteins expressed under iron-restriction/Challenged ATCC 19636)
*Group-6 (Vaccinated with ATCC 19636 proteins expressed under iron-restriction/Challenged Bovine 1477)
*Group-7 (Bovine 1477 FeCl₃ Vaccinated/Challenged Bovine 1477 chelators were used at the following concentration; 2,2-dipyridyl (800 μM), catechin and naringenin were used at 300 μM, and 2-pyridylmethyl-ethylene diamine was used at a concentration of 100 μM. Cultures were grown with each chelator for 8 hours, at which point the culture was subcultured a second time for an additional 12 hours. Each culture was subcultured for three consecutive passes at 12-hour intervals. At the end of the third pass, each culture was harvested by centrifugation at 10,000×g for 20 minutes. Each culture was washed twice by centrifugation at 10,000×g and resuspended in 20 ml Tris-buffered saline, pH 7.2 at 4° C.

Each bacterial pellet was resuspended in 45 ml of Tris-buffered saline, pH 7.2 (25 mM Tris and 150 mM NaCl) and the resulting bacterial suspensions were dispensed as 9-ml aliquots into 5 individual tubes, twenty tubes total. One milliliter of TBS containing 50 units of lysostaphin (Sigma, St. Louis, Mo.) was added to each tube to give a final concentration of 5 units/ml. Following incubation at 37° C. for 30 minutes while shaking at 200 rpm, 1 ml of TBS containing 0.1 mg of lysozyme (Sigma) was added to each tube. The bacterial suspensions were then incubated for an additional 45 minutes while shaking at 200 rpm. Next, suspensions were centrifuged at 3050×g for 12 minutes at 4° C. to pellet large cellular debris. The supernatants were collected by aspiration without disturbing the pellet. The supernatant was then centrifuged at 39,000×g for 2.5 hours. The resulting pellets, enriched for metal-regulated membrane proteins, were resuspended in 200 μL Tris buffer, pH 7.2. The protein solutions for each isolate were combined for a total volume of 1 ml and stored at −90° C.

The proteins obtained from the SAAV1, 19636, 1477 and 2176 S. aureus isolates grown under iron, zinc and copper deplete conditions included metal-regulated polypeptides.

Cell extracts, derived from each isolate were size-fractionated on SDS-PAGE gels using a 4% stacking gel and 10% resolving gel. Samples for electrophoresis were prepared by combining 10 μl of sample with 30 μl of SDS reducing sample buffer (62.5 mM Tris-HCL ph 6.8, 20% glycerol, 2% SDS, 5% beta-mercaptoethanol) boiled for 4 minutes. Samples were electrophoresed at 18 mA of constant current for 5 hours at 4° C. using a PROTEAN II xi cell power supply (BioRad Laboratories, Richmond, Calif., model 1000/500).

The SDS-PAGE patterns of the proteins grown under zinc and/or copper chelation showed unique banding patterns in all isolates that were different when compared to the same isolates grown under iron-restriction in the presence of 2,2'-dyipyridyl. For example, when the 19636 isolate was grown under iron-restriction or in the presence of the chelator 2,2'-dyipyridyl, unique iron-regulated proteins were expressed at the 87.73 kDa, 54.53 kDa, 38.42 kDa, 37.37 kDa, 35.70 kDa, 34.91 kDa and 33.0 kDa regions. These proteins were downregulated when the isolate was grown in the presence of ferric chloride. However, when the same isolate was grown in the presence of the zinc and or copper chelator, a novel subsets of proteins was expressed relative to the proteins expressed under iron-restriction; the new proteins having molecular weights of approximately 115 kDa, 88 kDa, 80 kDa, 71 kDa, 69 kDa, 35 kDa, 30 kDa, 29, kDa and 27 kDa. In addition, an 87.73 kDa protein was expressed under conditions of iron restriction or copper-restriction but not when cultures were zinc-restricted. The proteins expressed under iron-restriction appeared to be downregulated when growth was under either zinc-restriction and/or copper-restriction, but not completely shut off as seen when the isolate was grown in ferric chloride.

It appears that there are novel proteins expressed when the organism is grown under copper-restriction and/or zinc-restriction that are not expressed when the same isolate is grown under iron-restricted conditions. Since transitional metals are used by organisms to build enzymes that catalyze various biochemical reactions, the metal ions may play a vital role in microbial survival during a systemic infection. It is perhaps for this reason that during sepsis there is a transient decrease in the availability of these transitional metals, making them unavailable for growth of the organism. These novel proteins could very well enhance the protective efficacy of the existing composition grown under iron-restriction because they may also be expressed by the bacteria under the metal ion restriction experienced during systemic invasion.

Example 7

Compositions of the Present Invention can Also be Produced Under Large Scale Commercial Conditions Fermentation A cryogenic vial of the working seed (2 ml at $10^9$ CFU/ml) as described in Example 1 was used to inoculate 500 ml of Tryptic Soy Broth (TSB) without dextrose (Difco) pre-warmed to 37° C. containing 0.125 g/l 2,2-dipyridyl (Sigma), 2.7 grams BITEK yeast extract (Difco) and glycerol (3% vol/vol). The culture was incubated at 37° C. for 12 hours while stirring at 200 rpm at which time it was used to inoculate 2 liters of the above media and allowed to grow for an additional 4 hours at 37° C. This culture was used to inoculate a 20-liter VIRTIS bench-top fermentor, (Virtis, Gardiner, N.Y.) charged with 13 liters of the above-described media. The pH was held constant between 6.9 and 7.1 by automatic titration with 50% NaOH and 10% HCL. The stirring speed was adjusted at 400 rev/minute, and the culture aerated with 11 liters air/minute at 37° C. Foaming was controlled automatically by the addition of 11 ml defoamer (MAZU DF 204 Chem/Serv, Minneapolis, Minn.). The culture was allowed to grow continuously at these conditions for 4 hours at which time was sterilely pumped into a 150-liter fermentor (W. B. Moore, Easton, Pa.). The fermentor was charged with 120 liters tryptic soy broth without dextrose (3,600.0 grams), BITEK yeast extract (600 grams), glycerol (3,600 ml), 2,2-dypyrdyl (3.0 grams) and MAZU DF 204 defoamer (60 ml). The parameters of the fermentation were as follows: dissolved oxygen (DO) was maintained at 30%+/−10% by increasing agitation to 220 rev/minute sparged with 60 liters of air/minute and 10 pounds per square inch (psi) back pressure. The pH was held constant between 6.9 and 7.1 by automatic titration with 50% NaOH and 10% HCL and the temperature maintained at 37° C. At hour 4.5 ($OD_{540}$ 8-9) of the fermentation the culture was transferred to a 1,500 liter New Brunswick Scientific fermentor IF-15000 charged with 1200 liters tryptic soy broth without dextrose (36,000 grams), BITEK yeast extract (6,000 grams), glycerol (36,000 ml), 2,2-dypyrdyl (30.0 grams) and MAZU DF 204 defoamer (600 ml). The parameters of the fermentation were as follows: dissolved oxygen (DO) was maintained at 60%+/−10% with supplemental oxygen by increasing agitation to 300 rev/minute sparged with 300 to 1100 liters of air/minute and 5 pounds per square inch (psi) back pressure. As fermentation progressed supplemental oxygen was added from 0-90 liters/minute to assist in the control of dissolved oxygen. The pH was held constant between 6.9 and 7.4 by automatic titration with 50% NaOH and 10% HCL and the temperature was maintained at 37° C.

At approximately 5 hours post inoculation of the large fermentor the culture was supplemented with additional nutrients by feeding 70 liters of media containing 18,000 grams TSB without dextrose, 3,000 grams yeast extract 30.0 grams 2,2-dipyridyl and 18,000 ml of glycerol. The rate of feed was adjusted to approximately 28 liters/hour while increasing agitation. At the end of the feed the fermentation was allowed to continue for an additional 4 hours at which point the fermentation was terminated by lowing the temperature of the fermentor to 18° C. ($OD_{540}$ 35-40 at a 1:100 dilution).

Harvest

The bacterial fermentation was concentrated and washed using a Pall Filtron Tangential Flow MAXISET-25 (Pall Filtron Corporation, Northboro, Mass.) equipped with three 30 $ft^2$ Alpha 300-K open channel filters, catalog No. AS30005, (Pall Filtron) connected to a Waukesha Model U-60 feed pump (Waukesha Cherry-Burrell, Delevan, Wis.) The original culture volume of 1250 liters was reduced to 50 liters (2.5 liters/minute) using a filter inlet pressure of 30 psi and a retentate pressure of 5-6 psi. The bacterial retentate was adjusted back up to 150 liters using Tris-buffered Saline pH 8.5 and then concentrated again to 50 liters to help remove any contaminating exogenous proteins, such as exoproteins to include secreted toxins and proteases. The elevated pH of the tris-buffered saline helps prevent much of the proteolytic degradation that can occur during storage of the whole cell suspension. Protease inhibitors may be used instead of, or in addition to, an elevated pH. The retentate was mixed thoroughly while in the 200-liter tank using a bottom mount magnetically driven mixer. The retentate was sterilely dispensed (3.5 liters) into sterile 4 liter NALGENE containers No. 2122 and placed into a −20° C. freezer for storage as a breaking point in the manufacture, or could be further processed. The pellet mass was calculated by centrifuging 30 ml samples of the fermented culture and final harvest. Briefly, pre-weighted 50 ml NALGENE conical tubes were centrifuged at 39,000×g for 90 minutes in a Beckman J2-21 centrifuge using a JA-21 rotor (Beckman Instruments, Palo Alto Calif.). At the end of the run, the supernate was poured off and the tubes were weighed again. The pellet mass was calculated for each stage. The fermentation process yielded a wet pellet mass of approximately 60 kilograms.

Disruption

Eighty kilograms of bacterial cell slurry in Tris-buffered Saline pH 8.5 was aseptically transferred into a steam in place 1000 liter jacketed process tank (Lee, Model 259LU) with a top mounted mixer (Eastern, Model TME-1/2, EMI Incorporated, Clinton, Conn.) containing 900 liters TBS pH 8.5. The bulk bacterial suspension was chilled to 4° C. with continuous mixing for 18 hours at 200 rpm at which time was disrupted by homogenization. Briefly, the 1000 liter tank containing the bacterial suspension was connected to a model C-500-B AVESTIN homogenizer, (Avestin Inc, Ottawa Canada). A second 1000 liter jacketed process tank (empty) was connected to the homogenizer such that the fluid in the process tank could be passed through the homogenizer, into the empty tank and back again, allowing for multiple homogenizing passes while still maintaining a closed system. The temperature during homogenization was kept at 4° C. At the start of the first pass, fluid was circulated at 70 psi via a Waukesha model 10DO pump (Waukesha) through the homogenizer (500 gallons/hour), while the homogenizer pressure was adjusted to 30,000 psi. Prior to the first pass, two pre-homogenizing samples were withdrawn from the homogenizer to establish a baseline for determining the degree of disruption and monitoring of pH. The degree of disruption was monitored by transmittance (% T at 540 nm at 1:100 dilution) compared to the non-homogenized sample. The number of passes through the homogenizer was standardized to give a final percent transmittance between 78-91% T at a 1:100 dilution preferably between 86-91%. After homogenization, the tank was removed from the homogenizer and put onto a chiller loop at 4° C. and mixed at 240 rpm.

Protein Harvest

The disrupted bacterial suspension containing the iron-regulated proteins as illustrated in FIG. 1 were collected by centrifugation using T-1 SHARPLES, (Alfa Laval Seperations, Warminster, Pa.). Briefly, the 1000 liter jacketed process tank containing the disrupted bacterial homogenate was fed into 12 SHARPLES with a feed rate of 250 ml/minute at 17 psi at a centrifugal force of 60,000×g. The effluent was collected into a second 1000 liter jacketed process tank through a closed sterile loop allowing for multiple passes through the centrifuges while maintaining a closed system. The temperature during centrifugation was kept at 4° C. The homogentae was passed 8 times across the centrifuges. Approximately 50% of the protein was collected after the second pass, at which point, the homogenate fluid was concentrated to ⅓ of its original volume, which shortened the process time for the next 6 passes. The homogenate tank was aseptically disconnected from the centrifuges and connected to a Millipore PELLICON Tangential Flow Filter assembly (Millipore Corporation, Bedford, Mass.), equipped with a 25 $ft^2$ screen-channel series Alpha 30K CENTRASETTE filter (Pall Filtron) connected to a Waukesha Model U30 feed pump for concentration. After concentration, centrifugation was continued until the process was completed. Protein was collected after each pass. The protein was collected, resuspended and dispensed in 50 liters Tris-buffered saline pH 8.5 containing 0.15% formulin (Sigma) as preservative.

Diafiltration

The protein suspension was washed by diafiltration at 4° C. to remove any exogenous proteins (proteases, toxins, cytoplasmic and metabolic enzymes etc). Briefly, the 50 liters of protein was sterilely transferred into a 200 liter process tank containing 150 liters sterile Tris-buffer saline, pH 8.5 equipped with a bottom mount Dayton mixer, Model 2Z846 (Dayton Electric, Chicago, Ill.) rotating at 125 rev/minute. The process tank was sterilely connected to a Millipore PELLICON Tangential Flow Filter assembly (Millipore Corporation), equipped with a 25 $ft^2$ screen-channel series Alpha 30K CENTRASETTE filter (Pall Filtron) connected to a Waukesha Model U30 feed pump. The 200 liter protein solution was concentrated by filtration to a target volume 50 liters at which point 150 liters of sterile saline was added. The protein suspension was then concentrated to approximately 50 liters. The protein concentrate was stored in a 50 liter jacketed process tank equipped with a top mounted mixer and stored at 4° C.

It is interesting to note that the composition derived from the large scale process using homogenization as a means of disruption generated identical banding profiles as examined by SDS-PAGE as compared to the smaller scale process described in Example 1. These results show that lysostaphin could be replaced as the bacterial lysis agent using the AVESTIN homogenizer C500-B. This discovery allows for the low cost generation of large volumes of iron-regulated proteins from staphlylococci.

Example 8

Hyper-Immunization of Mice and Preparation of Polyclonal Antibody

Passive immunization with purified antibody isolated from mice vaccinated with proteins derived from S. aureus strain ATCC 19636 grown under iron-limiting conditions was protective against a homologous and heterologous S. aureus challenge. Fifteen adult CD1 mice were vaccinated as described in Example 3 with the protein composition derived from S. aureus strain ATCC 19636 grown under iron-deplete conditions as described in Examples 1 and 2. Mice were vaccinated intraperitoneally 3 times at 7 day intervals with 50 µg of protein composition at each vaccination. Seven days after the third immunization, mice were bled completely by cardiac puncture. Serum was pooled and antibody purified using standard ammonium sulfate precipitation. Exogenous serum proteins were removed first prior to antibody precipitation by adding 0.5 volumes of saturated ammonium sulfate pH 7.2. The solution was stirred at 100 rpm for 24 hours at 4° C. The solution was again centrifuged at 3000×g for 30 minutes. The supernatant was collected and precipitated again by adding enough saturated ammonium sulfate to bring the final concentration to 55% saturation. The solution was stirred at 100 rpm for 24 hours at 4° C. The precipitate was centrifuged at 3000×g for 30 minutes. The final pellet from each sample was resuspended into 2 ml PBS pH 7.2. The precipitated antibodies were then dialyzed using a 50,000 molecular cut off dialysis tubing (Pierce, Rockford Ill.) for 30 hours against three 1 liter changes of phosphate-buffered saline to remove ammonium sulfate. The first two liter changes were preserved with 0.02% sodium azide. The final 1 liter buffer change contained no preservative. The dialysate was collected and centrifuged again to remove any remaining debris at 3000×g for 30 minutes. The antibody solution was stored at 4° C. for less then 48 hours prior to use. Each sample was plated on blood agar to verify sterility prior to infusion.

Example 9

Passive Immunization and Challenge

In order to evaluate the protective effect of infused antibody raised against S. aureus proteins expressed during iron-limitation, two groups of 15 mice each were infused intraperitoneally with either the purified antibody preparation (Group 1) or physiological saline (Group 2) in a 200 µL infussion. An additional two groups of 15 mice each were infused subcutaneously with either the purified antibody preparation (Group 3) or physiological saline (Group 4). After 60 minutes, the 2 groups of 15 mice receiving an intraperitoneal infusion were challenged intraperitoneally with $1.3\times10^8$ cfu of S. aureus strain 19636. Similarly, the 2 groups of 15 mice receiving a subcutaneous infusion were challenged subcutaneously with $1.3\times10^8$ cfu of S. aureus strain 1477 to test for cross-protection against challenge by a different S. aureus strain. Mortality and/or lesion size was recorded for 5 days and the livers of all mice were removed post-mortem, homogenized and plated to determine the number of S. aureus present as a measure of systemic infection. The Kaplan-Meier survival curves (FIGS. 5 and 6) show the protective effect afforded by the infusion of antibodies from mice vaccinated with the S. aureus proteins expressed during iron restriction. Although the difference between the infused and control groups for the ATCC 19636-challenge groups was not significant (p=0.076, log-rank test), the liver of the single mouse that died within the antibody-infused group at Day 1 was cultured on blood agar to determine the absence and/or presence of the challenge organism (S. aureus). The culture derived from this mouse was negative for Staphylococcus and showed no growth on the blood agar plate or culture medium. In contrast, the livers of the mice that died within the placebo group, were all positive for the presence of Staphylococcus, in fact, pure cultures were obtained on each blood agar plate derived from the livers of these mice. While the liver data do not preclude the possibility that the mouse that died within the antibody-infused group died of S. aureus infection, the infection was not systemic, as it was in the placebo group, and the mouse may have died for other reasons. Censoring of this antibody-infused mouse death results in a significant difference between antibody-infused and placebo treatments (p=0.015, log-rank test). The data for the cross-challenge, where mice were infused with antibody generated after vaccination with ATCC 19636-derived proteins and challenged by S. aureus strain 1477, also showed a protective trend. Between 7 and 14 days post challenge, all mice in the infused and non-infused groups began to develop necrotic skin lesions. However, gross examination of mice clearly revealed a visible delay in the formation of an observable lesion as well as the severity of the lesion between the groups. Infused mice developed lesions more slowly as compared to non-infused control mice which developed lesion faster then infused mice and at a greater degree of severity. The infused mice healed faster then non-infused mice. This was clearly evident between 21 and 35 days post challenge. Gross examination of mice at 35 days post challenge showed that non-infused mice were severely disfigured and revealed a greater degree of scarring. In fact, many of these mice lost normal posture, in that they appeared twisted in appearance, in contrast to infused mice that did not develop nearly the extensive scar tissue and/or disfigurement as illustrated by the twisted appearance that the non-infused mice developed. Overall, these data suggest that interperitoneal infusion of antibodies raised against S. aureus iron-induced proteins can both protect against and limit the severity of S. aureus infection.

Example 10

Evaluation of a Vaccine Composition Derived from Staphylococcus aureus in a Chronically Infected Dairy Herd A commercial Dairy herd having a history of chronically high somatic cell counts attributable to Staphylococcus aureus was chosen for the evaluation of a vaccine composition as described in Example 1. The criterion for establishing vaccine efficacy of this experimental study was: 1) decreased incidence of clinical mastitis caused by Staphylococcus aureus among vaccinates compared to non-vaccinated controls, 2) improvement (i.e., a decrease) in somatic cell count among vaccinates compared to controls and 3) decrease in culture positive isolation rates of S. aureus between vaccinated and non-vaccinated controls. Blood will be taken at the time of the first vaccination (day 0) and again at 3 and 6 weeks post initial immunization. Injection site reactions or systemic reactions following vaccinations were monitored throughout the study. In addition, bulk tank milk samples were cultured and quantitatively enumerated to determine if there was a decrease in the number of CFU of *Staphylococcus aureus* cultured after vaccination.

Three of the *Staphylococcus* isolates derived from the chronically infected lactating cows within the herd were grown under conditions of iron-restriction and non-iron restricted conditions as described in Example 1. The three isolates were designated TTX101, TTX102, and TTX103. Extracted samples were examined by SDS-PAGE to compare banding profiles between isolates. Identical banding profiles were observed among isolates examined; the compositions made from each isolate included proteins having molecular weights of 87.73 kDa, 80.46 kDa, 65.08 kDa, 54.53 kDa, 37.37 kDa, 35.70 kDa, 34.91 kDa, 33.0 kDa and 31.83 kDa. These proteins are the same molecular weights as previously described in Table 7. In addition, when comparing the isolates identical banding profiles were seen with those proteins that were expressed in all conditions that were not regulated by iron: 150 kDa, 132 kDa, 120 kDa, 75 kDa, 58 kDa, 50 kDa, 44 kDa, 43 kDa, 41 kDa, and 40 kDa. These results were consistent with previous observations. One isolate designated as TTX101 was chosen as the isolate to manufacture a composition to be used in this study.

Example 11

Vaccine Preparation of *Staphylococcus aureus* (TTX101)

A composition was prepared as described in Example 1 using the isolate TTX101. The composition included proteins expressed under iron deplete conditions having molecular weights of 87.73 kDa, 80.46 kDa, 65.08 kDa, 54.53 kDa, 37.37 kDa, 35.70 kDa, 34.91 kDa, 33.0 kDa, and 31.83 kDa as well as non-metal-regulated proteins having molecular weights of 150 kDa, 132 kDa, 120 kDa, 75 kDa, 58 kDa, 50 kDa, 44 kDa 43 kDa 41 kDa, and 40 kDa. The immunizing composition derived from strain TTX101 was used to prepare the experimental vaccine by emulsifying the extracted protein suspension (400 µg total protein per milliliter) into a commercial adjuvant (EMULSIGEN, MVP Laboratories, Ralston Nebr.) using an IKA ULTRA TURRAX T-50 homogenizing vessel (IKA, Cincinnati, Ohio) to give a final dose of 800 µg total protein in a 2.0 ml injectable volume with an adjuvant concentration of 22.5% vol/vol. The vaccine was administered subcutaneously 2 times at 21 day intervals.

Example 12

Experimental Design and Herd Vaccination

Eighteen days before the first vaccination all lactating cows enrolled in the study (N=80) were tested for *S. aureus* by standardized aerobic bacteriological culture methods by culturing individual milk samples derived from each lactating cow. In addition, the Somatic Cell Counts (SCC) were enumerated by the Dairy Herd Improvement Association using standard methods. Fourteen of the 80 cows were clinically diagnosed with mastitis and were culture positive for *S. aureus*. The remaining cows (N=66) tested negative for *S. aureus*. The eighty cows were equally divided into two groups designated as group-1, vaccinated (N=40) and group-2, non-vaccinated (N=40). The fourteen clinically diagnosed *Staphylococcus* positive cows were equally distributed between both groups so that each study group contained 7 cows with clinical mastitis. The average SCC between groups prior to the first vaccination was 203,219 in the non-vaccinated controls compared to 240,443 in vaccinates (not statistically different p=0.7).

Eighteen days after the first sampling all cows in group 1 were vaccinated subcutaneously in the upper right shoulder with 2 ml of vaccine as described in Example 11. Ten days after the first vaccination milk samples were taken at this time period by the DHIA for the enumeration of somatic cells from each individual cow. Milk samples were not bacteriologically tested at this time period for determining the presence of *Staphylococcus*. The difference in the SCC between groups at this time period was 125,241 (vaccinates) compared to 196,297 (controls). This was a 36% difference in the number of somatic cells between vaccinates as compared to non-vaccinated controls. The difference in the SCC between the controls and vaccinates at this sampling period was not statistically different (p=0.5). The lack of statistical difference in the SCC between groups at both sampling periods was due to the large variation in individual SCC between cows. The injection site of each vaccinated cow was also examined at this same time period. None of the cows examined showed any adverse tissue reaction at the site of injection by physical examination. In addition, there was no measurable loss in milk production due to vaccination.

Twenty one days after the first vaccination all cows in group-1 (vaccinates) were given their second vaccination or booster. During the time period between first and second vaccination, cows in both groups (vaccinates and controls) developed teat damage due to a dramatic drop in the environmental temperature resulting in the formation of lesions at the end of the teat, resulting in the development of infected teats and potentially increasing the isolation of *Staphylococcus* during sampling, which was observed at the third sampling period. Twenty three days after the second vaccination milk samples were taken by the DHIA for the enumeration of Somatic Cells from each individual cow. Milk samples were also bacteriologically tested for the presence of *Staphylococcus aureus*. There was a dramatic increase in isolation rate of *S. aureus* at this time period in the cows that tested negative at the first sampling period. In the non-vaccinated controls 42.9% of these cows now tested positive for *S. aureus*, in contrast to the vaccinates, which only showed and increase of 35.5%. This was a 7.4% difference between vaccinates as compared to the non vaccinated controls. It's difficult to say that the improvement in the isolation rate of *S. aureus* in the vaccinated group was due to the effect of the vaccine alone. One cannot overlook the difficulty in obtaining clean milk samples from cows that had teat damage which could increase the potential contamination of the milk by *S. aureus* when obtaining the sample. Nevertheless, there was a significant difference in the average SCC between vaccinates compared to controls. The average SCC of the vaccinated group was 222,679 compared to 404,278 somatic cells as measured in the control group. This was a 44.9% difference between vaccinates when compared to the non vaccinated controls. It's interesting to speculate that the difference seen in the SCC between these groups also coincides with the difference in the isolation rate of *S. aureus* between groups. However, due to the large variation in SCC between individual animals and the small sample size of the experimental trial in the number of animals the difference was not statistically different (p=0.28).

At this same time period the injection site of each vaccinated cow was examined for any adverse tissue reaction that may have been caused by the vaccine composition. None of the cows examined showed any adverse reaction at the site of injection by physical examination. The vaccine compositions appeared to be highly tissue compatible and caused no measurable loss in milk production after each vaccination.

Monitoring of the cows is continued by measuring SCC and milk samples for the presence or absence of *Staphylococcus aureus*. Some of the cows of each group are vaccinated a third time at 42 days after the second vaccination. There appears to be a difference favoring the use of the vaccine composition for decreasing somatic cell counts and controlling infection caused by *Staphylococcus aureus*. Further monitoring includes serology based on antibody titers to the vaccine composition, changes in milk production in vaccinated cows due the improvement in health, and decreased SCC of vaccinated animals compared to non-vaccinated cohorts. In addition, other experiments are conducted to investigate the protective index of the vaccine based on dose response following challenge with a virulent *S. aureus*.

Example 13

Since the molecular weights of the proteins among the different *S. aureus* strains have been demonstrated to be similar and since heterologous protection was observed in the mouse challenge study, we sought to determine if the proteins sharing similar molecular weights in FIG. 1 were similar proteins. The technique chosen to characterize the proteins was matrix-assisted laser desorption/ionization mass spectrometry (MALDI-MS). A portion of the composition was resolved using SDS-PAGE as described in Example 1, and the gel was stained with COOMASSIE Brilliant blue to visualize the proteins.

Materials and Methods

Excision and Washing.

The gel was washed for 10 minutes with water twice. Each protein band of interest was excised by cutting as close to the protein band as possible to reduce the amount of gel present in the sample.

Each gel slice was cut into 1×1 mm cubes and placed in 1.5 ml tube. The gel pieces were washed with water for 15 minutes. All the solvent volumes used in the wash steps were approximately equal to twice the volume of the gel slice. The gel slice was next washed with water/acetonitrile (1:1) for 15 minutes. When the proteins had been stained with silver, the water/acetonitrile mixture was removed, the gel pieces dried in a SPEEDVAC vacuum concentrator/dryer (ThermoSavant, Holbrook, N.Y.) and then reduced and alkylated as described below. When the gel pieces were not silver-stained, the water/acetonitrile mixture was removed, and acetonitrile was added to cover until the gel pieces turned a sticky white, at which time the acetonitrile was removed. The gel pieces were rehydrated in 100 mM $NH_4HCO_3$, and after 5 minutes, a volume of acetonitrile equal to twice the volume of the gel pieces was added. This was incubated for 15 minutes, the liquid removed, and the gel pieces dried in a SPEEDVAC.

Reduction & Alkylation.

The dried gel pieces were rehydrated in 10 mM DTT and 100 mM $NH_4HCO_3$, and incubated for 45 minutes at 56° C. After allowing the tubes to cool to room temperature, the liquid was removed and the same volume of a mixture of 55 mM iodoacetamide and 100 mM $NH_4HCO_3$ was immediately added. This was incubated for 30 minutes at room temperature in the dark. The liquid was removed, acetonitrile was added to cover until the gel pieces turned a sticky white, at which time the acetonitrile was removed. The gel pieces were rehydrated in 100 mM $NH_4HCO_3$, and after 5 minutes, a volume of acetonitrile equal to twice the volume of the gel pieces was added. This was incubated for 15 minutes, the liquid removed, and the gel pieces dried in a SPEED VAC. If the gel was stained with COOMASSIE blue, and residual COOMASSIE still remained, the wash with 100 mM $NH_4HCO_3$/acetonitrile was repeated.

In-Gel Digestion.

Gel pieces were completely dried down in a SPEED VAC. The pieces were rehydrated in digestion buffer (50 mM $NH_4HCO_3$, 5 mM $CaCl_2$, 12.5 nanograms per microliter (ng/µl) trypsin) at 4° C. Enough buffer was added to cover the gel pieces, and more was added as needed. The gel pieces were incubated on ice for 45 minutes, and the supernatant removed and replaced with 5-2 µl of same buffer without trypsin. This was incubated at 37° C. overnight in an air incubator.

Extraction of Peptides.

A sufficient volume of 25 mM $NH_4HCO_3$ was added to cover gel pieces, and incubated for 15 minutes (typically in a bath sonicator). The same volume of acetonitrile was added and incubated for 15 minutes (in a bath sonicator if possible), and the supernatant was recovered. The extraction was repeated twice, using 5% formic acid instead of $NH_4HCO_3$. A sufficient volume of 5% formic acid was added to cover gel pieces, and incubated for 15 minutes (typically in a bath sonicator). The same volume of acetonitrile was added and incubated for 15 minutes (typically in a bath sonicator), and the supernatant was recovered. The extracts were pooled, and 10 mM DTT was added to a final concentration of 1 mM DTT. The sample was dried in a SPEEDVAC vacuum concentrator/dryer to a final volume of approximately 5 µl.

Desalting of Peptides.

The samples were desalted using a ZIPTIP pipette tips (C18, Millipore, Billerica, Mass.) as suggested by the manufacturer. Briefly, a sample was reconstituted in reconstitution solution (5:95 acetonitrile:$H_2O$, 0.1%-0.5% trifluoroacetic acid), centrifuged, and the pH checked to verify that it was less than 3. A ZIPTIP was hydrated by aspirating 10 µl of solution 1 (50:50 acetonitrile:$H_2O$, 0.1% trifluoroacetic acid) and discarding the aspirated aliquots. This was followed by aspirating 10 µl of solution 2 (0.1% trifluoroacetic acid in deionized $H_2O$) and discarding the aspirated aliquots. The sample was loaded into the tip by aspirating 10 µl of the sample slowly into the tip, expelling it into the sample tube, and repeating this 5 to 6 times. Ten microliters of solution 2 was aspirated into the tip, the solution discarded by expelling, and this process was repeated 5-7 times to wash. The peptides were eluted by aspirating 2.5 µl of ice cold solution 3 (60:40, acetonitrile:$H_2O$, 0.1% trofluoroacetic acid), expelling, and then re-aspirating the same aliquot in and out of the tip 3 times. After the solution has been expelled from the tip, the tube is capped and stored on ice.

Mass Spectrometric Peptide Mapping.

The peptides were suspended in 10 µl to 30 µl of 5% formic acid, and analyzed by MALDI-TOF MS (Bruker Daltonics Inc., Billerica, Mass.). The mass spectrum of the peptide fragments was determined as suggested by the manufacturer. Briefly, a sample containing the peptides resulting from a tryptic digest were mixed with matrix cyano-4-hydroxycinnamic acid, transferred to a target, and allowed to dry. The dried sample was placed in the mass spectrometer, irradiated, and the time of flight of each ion detected and used to determine a peptide mass fingerprint for each protein present in the composition. Known polypeptides were used to standardize the machine.

Data Analysis.

The experimentally observed masses for the peptides in each mass spectrum were compared to the expected masses of proteins using the Peptide Mass Fingerprint search method of the MASCOT search engine (Matrix Science Ltd., London, UK, and www.matrixscience.com, see Perkins et al., Electrophoresis 20, 3551-3567 (1999)). The search parameters included: database, MSDB or NCBInr; taxonomy, bacteria (eubacteria) or Firmicutes (gram-positive bacteria); type of search, peptide mass fingerprint; enzyme, trypsin; fixed modifications, carbamidomethyl (C) or none; variable modifications, oxidation (M), carbamidomethyl (C), the combination, or none; mass values, monoisotopic; protein mass, unrestricted; peptide mass tolerance, between ±150 ppm and ±430 ppm, or ±1 Da; peptide charge state, Mr; max missed cleavages, 0 or 1; number of queries, 20.

Results

The result of this search was a mass fingerprint for each protein present in the composition is shown in Tables 2, 3, 4, and 5.

Example 14

Identification of Iron-Regulated Protein Families Using Microarray-Based Gene Expression Analysis of *S. aureus* Grown Under Low Iron Conditions For microarray analysis, bacteria were cultured in chemically defined media (CDM) made from individual stock solutions (Table 10).

TABLE 10

Chemically defined medium (CDM) for *Staphylococcus aureus*

|  | [Final] | Stock composition | Add to 1 L |
|---|---|---|---|
| Salts (20X) | g/L | g/500 ml | 50 ml |
| $K_2HPO_4$ | 7 | 70 | |
| $KH_2PO_4$ | 2 | 20 | |
| $Na_3$citrate | 1.47 | 14.7 | |
| $(NH_4)_2SO_4$ | 1 | 10 | |
| Carbohydrate (40X) | g/L | g/500 ml | 25 ml |
| Glucose | 5 | 100 | |
| Vitamins (1000X) | mg/L | mg/100 ml | 1 ml |
| Thiamine | 1 | 100 | |
| Nicotinic acid | 0.5 | 50 | |
| Biotin | 0.005 | dilution* | |
| Calcium pantothenate | 0.25 | 25 | |
| Nucleotides (100X) | mg/L | mg/100 ml* | 10 ml |
| *Dissolve in 100 ml 2N HCl | | | |
| Adenine | 5 | 50 | |
| Guanine | 5 | 50 | |
| Cytosine | 5 | 50 | |
| Uracil | 5 | 50 | |
| Thymine | 10 | 200 | |
| Micronutrients (1000X) | μM | mg/100 ml stockAB* | 1 ml |
| *Make stocks A and B, then add 1 ml of each to 98 ml ddH20 to make final stock | | | |
| (A) | | | |
| $CaCl_2$ | 0.5 | 735 | |
| $H_3BO_3$ | 0.5 | 309 | |
| $CoCl_2$ | 0.05 | 118 | |
| $(NH_4)_6Mo_7O_{24}$ (B) | 0.005 | 62 | |
| $CuSO_4$ | 0.1 | 125 | |
| $MnSO_4$ | 0.1 | 169 | |
| $ZnSO_4$ | 0.05 | 144 | |
| Individual | | | |
| $MgSO_4$ | 100 | | |
| $FeSO_4$ or other | 10-50 | | |
| Amino acids (200X) | mg/L | g/100 ml | 5 ml |
| *Autoclave unless otherwise noted | | | |
| Refrigerate | | | |
| Aspartic acid (0.1M HCl) | 90 | 1.8 | |
| Proline | 80 | 1.6 | |
| Alanine | 60 | 1.2 | |
| Histidine | 20 | 0.4 | |
| Valine | 80 | 1.6 | |
| Arginine | 50 | 1.0 | |
| Serine | 30 | 0.6 | |
| Methionine | 3 | 0.06 | |
| Isoleucine | 30 | 0.6 | |
| Dark refrigerated filtered | | | |
| Tryptophan | 10 | 0.2 | |
| Tyrosine (0.5M NaOH) | 50 | 1.0 | |
| Room temperature | | | |
| Glutamic acid | 100 | 2.0 | |
| Leucine | 90 | 1.8 | |
| Phenylalanine | 40 | 0.8 | |
| Glycine | 50 | 1.0 | |
| Threonine | 30 | 0.6 | |
| Lysine | 50 | 1.0 | |
| Fresh daily | | | |
| Cysteine | 20 | 0.4 | |

METHOD OF MAKING. For making iron-deplete media, combine all stock solutions except cations and micronutrients and bring to proper volume in volumetric flask using MilliQ purified water and leaving enough void volume to accommodate cation additions. Add 15 g CHELEX resin per 1 L media and stir at room temperature for at least 2 hours. Filter solution into sulfuric acid (10%) treated glass bottle using 2 μm bottle-top filter. Add filtered cation stock solutions and store at 4° C. in the dark for up to 2 weeks.

*S. aureus* strains RF122 (isolated from bovine mastitis) and MSA553 (isolated from human toxic shock syndrome) were used. Both isolates were streaked on tryptic soy broth agar directly from secondary-passage freezer stocks prior to use in experiments. CDM contained final citrate concentrations approximately analogous to that in bovine milk (5 mM). For iron-free CDM, the following components were combined (0.998 L total volume) and added to 15 g CHELEX resin (BioRad Laboratories, Hercules, Calif.), then stirred for 1.5 hours at room temperature: salt, glucose, amino acids, vitamins, and nucleotides. The deferrated base media was then filtered using 2 μm bottle-top filters (Nalgene Nunc International, Rochester N.Y.) into sulfuric acid-treated bottles, after which micronutrients and 100 μM $MgCl_2$ (both solutions prepared in acid-treated glassware with MilliQ water) were added. CDM was stored at 4° C. in the dark until use.

A single bacterial colony was inoculated into 3 ml iron-deplete CDM in a 25 ml acid-treated glass culture tube and shaken overnight at 250 rpm in a 37° C. incubator. One milliliter of the subculture was then used to inoculate 500 ml of CDM in a 2500 ml Erlenmeyer flask the following day. Cultures were incubated at 37° C. with shaking at 250 rpm. Iron-deplete CDM cultures took approximately twice as long as CDM+50 µM FeSO$_4$ to reach an OD of 1.0 (18 hrs versus 36 hours). At mid-log phase (OD=0.600), 4×100 ml culture aliquots were distributed into 500 ml Erlenmeyer flasks and allowed to shake in the incubator for 10 minutes prior to the addition of experimental iron solutions. To one flask, 300 µl bovine lactoferrin (50 mg/ml, Sigma-Aldrich, St. Louis, Mo.) were added for a final concentration of 150 µg/ml. To another flask, 50 µl ferric citrate (100 mM) were added. The remaining two control flasks received no supplements. At 5, 30, 60 and 120 minutes, 7.5 ml of culture were collected and added to 5 ml guanidine thiocyanate solution containing β-mercaptoethanol and 0.5% sodium lauryl sarcosine. Solutions were mixed thoroughly to halt transcription and centrifuged at 4,000×g for 8 minutes at 8° C.; supernatant was poured off and cells were frozen in 250 µl TRIZOL (Invitrogen) using an ethanol/dry ice bath, then stored at −80° C. until RNA extraction.

For RNA extraction, cell pellets were thawed on ice and 750 µl TRIZOL (Invitrogen, Carlsbad Calif.) were added. Cells were resuspended by vortex and the slurry was transferred to a 2 ml screw cap tube containing 0.1 mm silica-zirconium beads, then beat 3×2 minutes in a BEADBEATER (Biospec Products, Inc., Bartlesville, Okla.) with ice incubation between repetitions. Slurries were incubated an additional 20 minutes at room temperature, followed by centrifugation to pellet beads and cellular components. 400 µl chloroform were added and mixed by inversion, incubated for 10 minutes at room temperature and tubes were centrifuged 8 minutes at 12,000×g at 8° C. The aqueous layer was removed and the RNA precipitated with 400 µl isopropanol followed by washing with 1 ml 70% ethanol. Clear RNA pellets were air-dried briefly and resuspended in 100 µl RNase-free H$_2$O. DNA was digested using standard DNase kit (Qiagen, Valencia Calif.) followed by cleanup according to manufacturer's recommendations on RNeasy columns (Qiagen). Finally, a TURBO DNA-free kit (Ambion, Austin Tex.) was used to ensure elimination of DNA from the preparation. RNA was measured on a spectrophotometer and run on an Agilent BIOANALYZER (Agilent, Palo Alto Calif.) to verify quality and quantity prior to the generation of cDNA for microarray hybridization.

Microarray analysis was carried out according to established protocols. The array, featuring 3841 70mer oligonucleotides (Illumina, San Diego Calif.) representing open reading frames (ORFs) from nine sequenced S. aureus genomes including RF122 and MSA553, was spotted in triplicate on GAPS II aminosaline coated slides (Corning, Acton Mass.) using a BioRobotics MICROGRID II Array Spotter (BioRobotics, Cambridge UK). Slides were rehydrated, UV cross-linked and stored under dessication. Immediately prior to hybridization, slides were incubated for 1 hour at 42° C. in prehybridization buffer consisting of 25 ml formamide, 12.5 ml 20×SSC, 12 ml dH2O, 500 µL 10% SDS and 0.5 g BSA. Slides were rinsed with 2 L MilliQ water and dried by centrifugation. To prepare samples, 8-10 µg total bacterial RNA were incubated with 20 µg random hexamers at 70° C. for 10 minutes, followed by reverse transcription with amino-allyl incorporation using SUPERSCRIPT II (Invitrogen) and amino-allyl coupled dUTP (Sigma). Labeled cDNA was neutralized, purified, dried and resuspended with Cy3 or Cy5 fluorescent dyes (Amersham Biosciences Corp., Piscataway N.J.); coupling proceeded for 2 hours. Fluorescently labeled cDNA samples (12 µl each) were washed using a QIAGEN PCR purification kit, combined and added to 9.8 µl formamide, 6.8 µL 20×SSC, 3.4 µl salmon speilu DNA (10 mg/ml, Invitrogen) and 1 µl 10% SDS. Samples were incubated for 2 minutes at 99.9° C. in a thermal cycler and allowed to cool prior to array application. Probes were then applied to array, covered with a glass coverslip and incubated overnight in a 42° C. waterbath. Slides were washed thoroughly in diluted SSC buffers after 12-16 hours of incubation and scanned using an Axon 4100B Scanner and Axon GENEPIX Software (Axon Instruments, Union City Calif.). Raw intensity data were exported to GENESPRING (Agilent Technologies, [Silicon Genetics], Palo Alto Calif.) for normalization and filtering. Spots were globally noinialized, filtered based on minimum (>1500) raw intensity values and the triplicates were averaged. Each experiment was run twice and a single slide was run for each using a dye-swap between matching timepoints. Thus, at least 6 dye-swapped datapoints were generated for each gene at each timepoint, representing at least 2 biological replicates. Data were further analyzed by hierarchical clustering (Euclidian distance, average linkage, UPGMA) and K-means clustering (uncentered correlation based measured distance) using EPCLUST (Jaak Vilo, EBI) and SPOTFIRE (SpotFire, Somerville, Mass.). Significance Analysis for Microarrays (SAM, (157)) was used on median-centered log ratios using the one-class model across all timepoints to determine if expression of the gene differed significantly from zero. Stringent delta values were used so that the percentage of false positives was estimated to be zero. A summary of operons showing similar up or downregulation by SAM analysis is shown in Table 11, supporting the ability of the arrays to detect biological responses.

TABLE 11

Operonic clusters with coordinated transcriptional responses identified using microarray analysis of gene expression of S. aureus

| | | | No. of coordinately expressed probes | |
| --- | --- | --- | --- | --- |
| Operon ID | Function | Response | Contiguous unregulated genes | Functionally related but not contiguous |
| Sir | cation transport | upregulated in low iron | 3 | 0 |
| Fhu | cation transport | upregulated in low iron | 3 | 1 |
| Opp | oligopeptide transport | upregulated in low iron | 9 | N/A |
| Mnt | cation transport | upregulated in low iron | 3 | 1 |
| Pfl (Formate acetyl-transferase) | fermentation | upregulated in presence of lactoferrin | 2 | 4 |

For standard cloning of proteins, the appropriate genes were amplified from DNA extracted from S. aureus (strain ATCC19636) by standard polymerase chain reaction. Primers were designed to incorporate StuI and KpnI restriction endonuclease sites and are shown below.

TABLE 12

Cloning Primers:

| Gene (primer) | Primer Sequence | SEQ ID NO |
|---|---|---|
| Pflb (5' to 3') | GCAGGCCTTTAGAAACAAATAAAAATCATG | 507 |
| Pflb (3' to 5') | TATGGTACCTTACATACTTTCATGGAATGTACG | 508 |
| Opp1A (5' to 3') | GCAGGCCTAAAAAAGAAAACAAGCAATTAA | 509 |
| Opp1A (3' to 5') | TATGGTACCTTATTTATACTGCATTTCATTGAA | 510 |
| SirA (5' to 3') | GCAGGCCTTCATCTGATAGCA AAGATAAGG | 511 |
| SirA (3' to 5') | TATGGTACCTTATTTTGATTGTTTTTCAATATT | 512 |
| SYN2 (5' to 3') | GCAGGCCTAAAGAATCATCAACTAAA | 513 |
| SYN2 (3' to 5') | TATGGTACCCTTTTGTTCTTTTTTTGA | 514 |
| FhuD (5' to 3') | GCAGGCCTACTGAAGAGAAAACTGAAATGA | 515 |
| FhuD (3' to 5') | TATGGTACCTTATTTTGCTTTTTCTGCAATTTT | 516 |
| SYN1 (5' to 3') | GCAGGCCTGGTAGCGACGATAATGGCTCGT | 517 |
| SYN1 (3' to 5') | TATGGTACCTTATTTTCTATAAATTGCATCTCT | 518 |
| MntC (5' to 3') | GCAGGCCTAGTGATAAGTCAAATGGCAAACTA | 519 |
| MntC (3' to 5') | TATGGTACCTTATTTCATGCTTCCGTGTACAG | 520 |
| SstD (5' to 3') | GCAGGCCTTCAGAAACTAAAGGTTCTAAAGAT | 521 |
| SstD (3' to 5') | TATGGTACCTTATTTTACAACTTTTTCAAGTT | 522 |
| FhuD2 (5' to 3') | GCAGGCCTACTAAATCTTATAAAATGGACGAT | 523 |
| FhuD2 (3' to 5') | TATGGTACCTTATTTTGCAGCTTTTAATTAATT | 524 |

DNA extracted from *S. aureus* ATCC19636 was used as the template. DNA amplicons were verified by gel electrophoresis and the amplified bands of DNA were excised, purified, digested and ligated into cut pQE30-Xa vector, transformed into competent XL-1 *E. coli* and screened for ampicillin resistance. Resistant clones were screened for plasmid inserts using colony PCR.

Example 15

Screening of Immunoreactivity of Protective Protein Candidates

To evaluate the antibody reactivity of the proteins identified from MALDI-TOF analysis (Example 13) and/or microarray and genomic analysis (Example 14), a two-part screen was used to evaluate individually expressed staphylococcal proteins. The rapid first screen used transcriptionally active PCR fragments to survey antibody binding to small amounts of candidate protein expressed using a cell-free *E. coli* lysate. The second screen used standard PCR-based cloning, expression and purification of proteins in *E. coli* using a commercial vector (pQE30Xa, Qiagen, Valencia Calif.) in order to validate positive candidates from the first screen. The second screen also generated master seed stocks of *E. coli* host cells containing the expression vector corresponding to each immunoreactive protein candidate for production and purification of sufficient protein for vaccination and experimentation.

A high-throughput method for generating individual SIRP antigens was used to test several candidate genes encoding *S. aureus* proteins involved in metal metabolism. This method generates a transcriptionally active PCR (TAP) amplicon using a 2-step PCR reaction with primers that add a promoter, terminator and C-terminal His$_6$ tag. The resulting transcriptionally active amplicons were used as a template for protein production in a cell-free in vitro transcription/translation reaction consisting of *E. coli* cell lysate, amino acids and buffers. The two-step PCR reaction required a first set of primers specific to the gene of interest that also included a linker sequence matching the second set of primers. Each primer set for the first step of PCR was designed to exclude membrane-processing signal sequences to prevent integration into the cell membrane and are shown below.

TABLE 13

TAP Primers:

| Gene (primer) | Primer Sequence | SEQ ID NO |
|---|---|---|
| Pflb (5' to 3') | AGAAGGAGATATACCATGTTAGAAACAAAT | 525 |
| Pflb (3' to 5') | TTAATGATGATGATGATGATGCATACTTTCATG | 526 |
| Opp1A (5' to 3') | AGAAGGAGATATACCATGAGAAAACTAACT | 527 |

TABLE 13-continued

TAP Primers:

| Gene (primer) | Primer Sequence | SEQ ID NO |
|---|---|---|
| Opp1A (3' to 5') | TTAATGATGATGATGATGATGTTTATACTGCAT | 528 |
| SirA (5' to 3') | ATAAGGAGATATACCATGAATAAAGTAATT | 529 |
| SirA (3' to 5') | TTAATGATGATGATGATGATGTTTTGATTGTTT | 530 |
| SYN2 (5' to 3') | AGAAGGAGGATATACCATGAGAGGTCTAAAAACTTTT | 531 |
| SYN2 (3' to 5') | TTAATGATGATGATGATGATGCTTTTGTTCTTTTITTGA | 532 |
| FhuD (5' to 3') | AGAAGGAGGATATACCATGAATAGGAATATCGTTAAA | 533 |
| FhuD (3' to 5') | TTAATGATGATGATGATGATGTTTTGCTTTTTCTGCAAT | 534 |
| SYN1 (5' to 3') | AGAAGGAGGATATACCATGAAGAAATCGTTAATTGCT | 535 |
| SYN1 (3' to 5') | TTAATGATGATGATGATGATGTTTTCTATAAATTGCATC | 536 |
| MntC (5' to 3') | AGAAGGAGATATACCAAAAAATTAGTA | 537 |
| MntC (3' to 5') | TTAATGATGATGATGATGATGTTTCATGCTTCC | 538 |
| SstD (5' to 3') | AGAAGGAGATATACCATGAAGAAAACAGTC | 539 |
| SstD (3' to 5') | TTAATGATGATGATGATGATGTTTTACAACTTT | 540 |
| FhuD2 (5' to 3') | AGAAGGAGATATACCATGAAAAAACTATTA | 541 |
| FhuD2 (3' to 5') | TTAATGATGATGATGATGATGTTTTGCAGCTTT | 542 |

A standard 50 µl PCR reaction was performed using (1 unit High Fidelity Taq DNA polymerase (Invitrogen), 0.2 µM primers, 2 mM dNTP (each), 2 mM final $Mg^{++}$, and approximately 5 ng of starting DNA template, buffered to 60 mM $TrisSO_4$ (pH 8.9) and 18 mM ammonium sulfate). The PCR cycling protocol included 1 minute of initial denaturation at 94° C., followed by 30 cycles as follows: Denature/94° C./30 s; Anneal/55° C./30 s; Extend/68° C., 90 s. Identical primers with the appropriate overlap were utilized for the second step PCR reaction and were supplied by the manufacturer (Genlantis). The resulting DNA PCR product was purified to eliminate residual primer, salt and DNA fragments and used as a template for a second reaction with a standard set of primers to add the promoter and terminator sequences using similar conditions. The DNA template was then purified and added to an E. coli cell-free Rapid Translation System RTS 100 reaction mix (Roche) containing 12 µl of E. coli lysate, 12 µl of amino acids, 10 µl of reaction mix, 1 µl of added methionine, 5 µl of reconstitution buffer and 10 µl of purified DNA template from the two-step PCR reaction. Following incubation for 5 hours at 30° C., one microliter of each protein sample (approximately 0.5 µg/µl total protein) was applied to polyvinylidene fluoride (PVDF) membrane after methanol saturation. The blot was blocked overnight with 5% NFDM/TTBS, incubated with iron-restricted protein, enhanced (IRPE) hyperimmunized mouse sera diluted 1:500 or anti-$His_6$ antibody (1:500), washed, incubated with secondary goat-anti mouse alkaline phosphatase (AP) conjugate (1:3000), washed and developed chromogenically (Bio-Rad AP color development kit) for 20 minutes. Lysates containing seroreactive polypeptides were identified.

Clones produced as described in Example 14 were grown to mid-log phase, induced with 1 mM IPTG and grown for four hours. Cells were pelleted, washed, and lysed in boiling SDS-PAGE loading buffer. Crude lysates were separated by SDS-PAGE and Coomassie stained. A second set of separated proteins was transferred to PVDF membrane and immunblotted with IRPE vaccine hyperimmunized mouse sera diluted 1:500 in 1% NFDM/TTBS. The blot was washed, incubated with alkaline phosphatase (AP)-conjugated goat anti-mouse secondary antibody, washed, and developed with chromogenic substrate.

Example 16

Preparation of Immunizing Compositions from Recombinantly-Produced Polypeptides In order to isolate recombinant S. aureus polypeptides for formulating a vaccine, the E. coli clones described in Example 14 were grown at 37° C. (225 rpm) to mid-log phase ($OD_{600}$=0.4-0.6) in 1 L of Trypic Soy Broth and then induced for 4 hours with 1 mM isopropyl β-D-1-thiogalactopyranoside (IPTG). Cultures were pelleted for 10 minutes at 4° C. in a Sorvall centrifuge (4000×g) and frozen at −80° C. prior to undergoing the purification procedure. Bacterial pellets were then processed by two different methods, depending on the solubility of the over-expressed S. aureus polypeptide.

For soluble polypeptides (e.g., MntC, FhuD, SYN2, SirA, or SYN1), bacterial pellets were resuspended in 25 ml of BUGBUSTER reagent (Novagen) and subjected to 15 minutes of sonication on ice using a Branson sonifier fitted with a microtip (65% duty cycle, 5 output). Insoluble material was removed by 10 minutes of centrifugation (4000×g). The soluble supernatant was filtered (0.2 µm) and subjected to metal affinity chromatography (Ni-NTA HIS-BIND, Novagen) according to the instructions provided by the manufacturer.

For insoluble polypeptides (e.g., PflB, or Opp1A), bacterial pellets were resuspended in 25 ml of BUGBUSTER reagent (Novagen), placed on a rocker platform for 10 minutes, and then subjected to centrifugation (15,000×g for 12 minutes). The resulting pellet was resuspended in 10 ml of BUGBUSTER plus 20 ml of diluted BUGBUSTER (1:10 in PBS) and subjected to centrifugation (5000×g for 12 minutes). The pellet was then resuspended in 20 ml of diluted BUGBUSTER and subjected to a final step of centrifugation (15,000×g for 12 minutes). The final pellet was resuspended in 10 ml of Buffer A (0.1 M $NaH_2PO_4$, 0.01 Tris-HCl, 8M Urea, pH 8.0) and incubated for 10 minutes on a rocking platform at room temperature. The samples were then subjected to centrifugation (12,000×g for 20 minutes), and the resulting supernatant was separated by metal affinity chromatography (Ni-NTA HIS-BIND, Novagen) according the instructions provided by the manufacturer, but with the following modifications. After charging the column, 10 ml of Buffer A was used to equilibrate the resin. Following the binding of polypeptide, the column was washed with 15 ml of Buffer B (0.1 M $NaH_2PO_4$, 0.01 Tris-HCl, 8M Urea, pH 6.0), and eluted using 15 ml of Buffer C (0.1 M $NaH_2PO_4$, 0.01 Tris-HCl, 8M Urea, pH 4.5).

Isolated recombinant polypeptides were eluted from the columns in a volume of 15 ml and placed in 20 kDa cutoff dialysis cassettes (Pierce) for dialysis against 2 L of phosphate-buffered saline (PBS). Following three buffer changes over the course of 30 hours, the polypeptides were removed, filtered (0.2 μm), and concentrated to 2-3 ml of volume using 20 kDa cutoff CENTRICON devices (Millipore). The concentrations of the purified polypeptides were determined using the standard BCA method (Pierce).

10 μg of each polypeptide was combined, and the volume adjusted to 100 μl with PBS, to form an immunizing composition.

Example 17

Mouse Vaccination

IV Challenge (Study A)

Fifty (N=50) female BALB/C mice obtained from Harlan Breeding Laboratories (Indianapolis, Ind.) weighing 16-22 grams were distributed into 3 groups (10-20 mice/group). Mice were housed in polycarbonate mouse cages (N=5 mice per cage). Food and water were supplied ad libitum to all mice. All vaccines were formulated with 50% IFA as an adjuvant. Mice were vaccinated subcutaneously with 0.1 ml of the appropriate composition two times at 14 day intervals as follows:

Group 1: Placebo, vaccinated with ovalbumin (70 μg/100 μl) (Placebo, 20 mice).

Group 2: Vaccinated with ATCC 25904 proteins expressed under iron-restriction (70 μg/100 μl) (SIRP Extract, 20 mice).

Group 3: Vaccinated with recombinant polypeptide MntC (10 μg/100 μl) (rMntC, 10 mice).

IP Challenge (Study B)

Forty (N=40) female BALB/C mice obtained from Harlan Breeding Laboratories (Indianapolis, Ind.) weighing 16-22 grams were equally distributed into 4 groups (10 mice/group). Mice were housed in polycarbonate mouse cages (N=5 mice per cage). Food and water were supplied ad libitum to all mice. All vaccines were formulated with 50% IFA as an adjuvant. Mice were vaccinated subcutaneously with 0.1 ml of the appropriate composition at 14 day intervals using either two vaccinations (Groups 1-3) or three vaccinations (Group 4) as follows:

Group 1: Placebo, vaccinated twice with ovalbumin (70 μg/100 μl) (Placebo).

Group 2: Vaccinated twice with ATCC 25904 proteins expressed under iron-restriction (70 μg/100 μl) (SIRP Extract).

Group 3: Vaccinated twice with recombinant polypeptides PflB, Opp1A, SirA, SYN2, FhuD, SYN1, and MntC (each 10 μg/100 μl, total protein 70 μg/100 μl) (rSIRP7 (2×)).

Group 4: Vaccinated three times with recombinant polypeptides POB, Opp1A, SirA, SYN2, FhuD, SYN1, and MntC (each 10 μg/100 μl, total protein 70 μg/100 μl) (rSIRP7 (3×)).

IC Challenge (Study C)

Thirty (N=30) female BALB/C mice obtained from Harlan Breeding Laboratories (Indianapolis, Ind.) weighing 16-22 grams were equally distributed into 3 groups (10 mice/group). Mice were housed in polycarbonate mouse cages (N=5 mice per cage). Food and water were supplied ad libitum to all mice. Mice were vaccinated subcutaneously with 0.1 ml of the appropriate composition two times at 14 day intervals as follows:

Group 1: Placebo, vaccinated with ovalbumin (70 μg/100 μl) (Placebo).

Group 2: Vaccinated with ATCC 25904 proteins expressed under iron-restriction (70 μg/100 μl) (SIRP Extract).

Group 3: Vaccinated with recombinant polypeptides PflB, Opp1A, SirA, SYN2, FhuD, SYN1, and MntC (each 10 μg/100 μl, total protein 70 μg/100 μl) (rSIRP7).

Example 18

Preparation of Challenge Organism

IV Challenge (Study A)

*Staphylococcus aureus* strain ATCC 25904 was used as a challenge organism. Briefly, a 1 μA loop of bacteria from a frozen glycerol stock grown in standard TSB (no iron restriction) was used to inoculate a 20 ml culture of TSB and incubated at 37° C. for 18 hours. 2.5 ml of this culture were passaged into 500 ml of fresh TSB. The culture was incubated at 37° C. for approximately two hours while rotating at 250 rpm until an optical density ($OD_{600}$) of 0.4 (Absorbance) was reached (mid-log phase), then the cells were centrifuged at 10,000×g for 10 minutes at 4° C. to pellet the bacteria. The bacterial pellet was washed by centrifugation in PBS at 4° C. The final pellet was resuspended in 20 ml of PBS. The final challenge dose was prepared by adding an aliquot of this concentrated bacterial culture to PBS to generate a solution with an $OD_{600}$ of 4.0 (A), corresponding to approximately $6.67 \times 10^8$ CFU/ml. Just prior to challenge, 1 ml of these bacterial suspensions was serially diluted and plated on agar to enumerate the number of colony-forming units (CFU) per mouse dose.

IP Challenge (Study B)

*Staphylococcus aureus* strain ATCC 25904 was used as a challenge organism. Briefly, a 1 μl loop of bacteria from a frozen glycerol stock grown in standard TSB (no iron restriction) was used to inoculate a 20 ml culture of TSB and incubated at 37° C. for 18 hours. 2.5 ml of this culture were passaged into 500 ml of fresh TSB. The culture was incubated at 37° C. for approximately two hours while rotating at 250 rpm until an optical density ($OD_{600}$) of 0.4 (Absorbance) was reached (mid-log phase), then the cells were centrifuged at 10,000×g for 10 minutes at 4° C. to pellet the bacteria. The bacterial pellet was washed by centrifugation in PBS at 4° C. The final pellet was resuspended in 20 ml of PBS. The final challenge dose was prepared by adding an aliquot of this concentrated bacterial culture to PBS to generate a solution with an $OD_{600}$ of 6.0 (A), corresponding to approximately $3.33 \times 10^9$ CFU/ml. Just prior to challenge, 1 ml of these bacterial suspensions was serially diluted and plated on agar to enumerate the number of colony-forming units (CFU) per mouse dose.

IV Challenge (Study C)

*Staphylococcus aureus* strain ATCC 25904 was used as a challenge organism. Briefly, a 1 μl loop of bacteria from a frozen glycerol stock grown in standard TSB (no iron restriction) was used to inoculate a 20 ml culture of TSB and incubated at 37° C. for 18 hours. 2.5 ml of this culture were passed into 500 ml of fresh TSB. The culture was incubated at 37° C. for approximately two hours while rotating at 250 rpm until an optical density ($OD_{600}$) of 0.4 (Absorbance) was reached (mid-log phase), then the cells were centrifuged at 10,000×g for 10 minutes at 4° C. to pellet the bacteria. The bacterial pellet was washed by centrifugation in PBS at 4° C. The final pellet was resuspended in 20 ml of PBS. The final challenge dose was prepared by adding an aliquot of this concentrated bacterial culture to PBS to generate a solution with an $OD_{600}$ of 4.0 (A), corresponding to approximately $6.67 \times 10^8$ CFU/ml. Just prior to challenge, 1 ml of these bacterial suspensions was serially diluted and plated on agar to enumerate the number of colony-forming units (CFU) per mouse dose.

Example 19

Challenge

IV Challenge (Study A)

Fourteen days after the second vaccination, mice in all groups (1-3) were intravenously challenged in the lateral tail vein with 0.3 ml of the appropriate organism. The three groups of mice were challenged identically with $2 \times 10^8$ CFU of *S. aureus* strain ATCC 25904 per mouse. Mortality was recorded daily for 10 days after challenge.

When comparing the mice challenged with the ATCC 25904 isolate, 80% of the placebo-vaccinated Group 1 mice died within 10 days of challenge (Table 14). This demonstrated that strain ATCC 25904 caused a high rate of mortality in mice at the dose level administered. In contrast to the mice in Group 1, only 25% of the mice in Group 2 (vaccinated with proteins extracted from strain ATCC 25904 following growth in iron-depleted conditions, SIRP Extract) died within 10 days post-challenge. These results illustrated that the mice challenged with strain ATCC 25904 were significantly protected by vaccination with the protein composition derived from iron-depleted ATCC 25904 (p=0.0006, logrank test for mortality). In addition, only 50% of the mice in Group 3 (vaccinated with recombinant MntC polypeptides, rMntC) died within 10 days of challenge, indicating that recombinant proteins offered protection against challenge with the ATCC 25904 strain (p=0.100, logrank test for mortality).

IP Challenge (Study B)

Fourteen days after the second vaccination, mice in all groups (1-4) were intraperitoneally challenged with 0.5 ml of the appropriate organism. The three groups of mice were challenged identically with $1 \times 10^9$ CFU of *S. aureus* strain ATCC 25904 per mouse. Mortality was recorded daily for 10 days after challenge.

When comparing the mice challenged with the ATCC 25904 isolate, 60% of the placebo-vaccinated Group 1 mice died within 10 days of challenge (Table 14). This demonstrated that strain ATCC 25904 caused a moderate rate of mortality in mice at the dose level administered. In contrast to the mice in Group 1, only 30% of the mice in Group 2 (vaccinated with proteins extracted from strain ATCC 25904 following growth in iron-depleted conditions, SIRP Extract) died within 10 days post-challenge. These results illustrated that the mice vaccinated with the protein composition derived from iron-depleted ATCC 25904 died at half the rate of placebo-vaccinated mice when challenged with strain ATCC 25904 (p=0.143, logrank test for mortality). Mice vaccinated with the combination of seven recombinant proteins showed a higher level of protection relative to placebo. Only 20% of the mice in Group 3 (vaccinated 2× with recombinant polypeptides, rSIRP7 2×) died within 10 days of challenge and only 10% of the mice in Group 4 (vaccinated 3× with recombinant polypeptides, rSIRP7 3×) died within 10 days of challenge, indicating that three vaccinations with recombinant proteins offered significant protection against challenge with the ATCC 25904 strain (p=0.040, logrank test for mortality).

IV Challenge (Study C)

Fourteen days after the second vaccination, mice in all groups (1-3) were intravenously challenged in the lateral tail vein with 0.3 ml of the appropriate organism. The three groups of mice were challenged identically with $2 \times 10^8$ CFU of *S. aureus* strain ATCC 25904. Mortality was recorded daily for 10 days after challenge.

When comparing the mice challenged with the ATCC 25904 isolate, 90% of the placebo-vaccinated Group 1 mice died within 10 days of challenge (Table 14). This demonstrated that strain ATCC 25904 caused a high rate of mortality in mice at the dose level administered. In contrast to the mice in Group 1, only 40% of the mice in Group 2 (vaccinated with proteins extracted from strain ATCC 25904 following growth in iron-depleted conditions, SIRP Extract) died within 10 days post-challenge. These results illustrated that the mice challenged with strain ATCC 25904 were significantly protected by vaccination with the protein composition derived from iron-depleted ATCC 25904 (p=0.0164, logrank test for mortality). In addition, only 40% of the mice in Group 3 (vaccinated with recombinant polypeptides, rSIRP7) died within 10 days of challenge, indicating that recombinant proteins offered significant protection against challenge with the ATCC 25904 strain (p 0.0255, logrank test for mortality).

Results are shown in Table 14 and FIG. 161.

TABLE 14

Mortality of Vaccinated and Non-Vaccinated Mice Following Challenge with *Staphylococcus aureus* ATCC isolate 25904.

| Groups | # Mice | # Dead | Percent mortality (%) |
|---|---|---|---|
| IV Challenge (Study A) | | | |
| Group 1 (Placebo) | 20 | 16/20 | 80 |
| Group 2 (SIRP Extract) | 10 | 5/20 | 25 |
| Group 3 (rMntC) | 10 | 5/10 | 50 |
| IP Challenge (Study B) | | | |
| Group 1 (Placebo) | 10 | 6/10 | 60 |
| Group 2 (SIRP Extract) | 10 | 3/10 | 30 |
| Group 3 (rSIRP (2x)) | 10 | 2/10 | 20 |
| Group 4 (rSIRP (3x)) | 10 | 1/10 | 10 |
| IV Challenge (Study C) | | | |
| Group 1 (Placebo) | 10 | 9/10 | 90 |
| Group 2 (SIRP Extract) | 10 | 4/10 | 40 |
| Group 3 (rMntC) | 10 | 4/10 | 40 |

Example 20

Passive Immunization Using Recombinantly-Prepared Polypeptides

A polyclonal antibody composition is prepared as described in Example 8, except that the mice are vaccinated with a composition of recombinant polypeptides prepared as described in Example 16.

The resulting antibody composition is used to passively immunize mice as described in Example 9. The immunized mice are challenged as described in Example 9.

Immunized mice will show decreased mortality compared to unvaccinated and placebo vaccinated mice.

Example 21

Large Scale Fermentation and Isolation of Recombinantly-Produced Polypeptides

A master seed stock of the recombinant *E. coli* of Example 14 can be prepared by growing the organism in 2000 ml of sterile RM medium (20 g casamino acids, 60 g $Na_2HPO_4$, 30 g $KH_2PO_4$, 5 g NaCl 10 g $NH_4Cl$ per liter and 100 ug/ml ampicillin) for 8 hours at 37° C. The bacteria can be harvested by centrifugation at 10,000×g for 30 minutes. The culture can be washed twice by centrifugation (10,000× g) and the final bacterial pellet resuspended in 500 ml of sterile RM medium containing 20% sterile glycerol. One milliliter of the culture will be transferred to a 2 ml cryovial and stored at −85° C.

A cryovial (1 ml) of the recombinant master seed stock can be used to inoculate a 100 ml culture flask containing the medium described above, with the exception of having 2 g casamino acids and 0.5% glucose ("modified RM medium"). The culture can be incubated at 37° C. for seven hours, at which time it can be inoculated into 2 liters of modified RM medium and allowed to grow for an additional four hours at 37° C. This culture can be used to inoculate a 30-liter New Brunswick BIOFLOW 4 bench-top fermenter charged with 20 liters of modified RM medium except the final concentration of casamino acids will be 20 g/liter ("fermentation RM medium"). The pH of the fermentation medium can be held maintained between 6.9 and 7.2 by automatic titration with 30% NaOH and 10% HCl. The fermentation culture can be stirred at 350 rev/minute, and the culture can be aerated with 11 liters/minute at 37° C. Foaming can be controlled automatically by the addition of 0.4% silicone defoamer (ANTIFOAM-B, J. T. Baker, N.J.). The culture can be allowed to grow continuously at these conditions for four hours ($OD_{600}$=4.0-6.0), at which time the culture can be pumped into a 150-liter fermenter (W. B. Moore, Easton PN), charged with 110 liters of fermentation RM medium and 0.2% defoamer. The parameters of the fermentation can be as follows: 650 rpm, 60% DO, 50 slpm air, 10 psi back pressure, 37° C., and pH held at 7.2 with NaOH. After reaching late exponential phase growth (approximately six hours, $OD_{600}$=15.0), recombinant proteins can be induced by adding of 150 ug/ml IPTG. The fermentation can be allowed to grow for an additional three hours at which point the fermentation can be terminated by lowering the temperature of the fermentor to 18° C. ($OD_{600}$ 20-25 at a 1:100 dilution).

After fermentation, the recombinantly-produced polypeptides can be harvested by conventional means. The cells are disrupted (e.g., by homogenization) to release the recombinantly-produced polypeptides, some of which are soluble and some of which are insoluble.

Soluble polypeptides can be concentrated by tangential flow filtration, detergent solubilized, and harvested by metal affinity chromatography. The collected soluble polypeptides can be isolated as described for the isolation of soluble polypeptides in Example 16.

Insoluble proteins can be harvested by high speed centrifugation. The pellet of insoluble polypeptides can be collected and then isolated as described for the isolation of insoluble polypeptides in Example 16.

Example 22

Mouse Vaccination

Recombinantly-produced SirA, SYN2, FhuD, and MntC polypeptides are prepared and isolated as described in Example 16.

Thirty (N=30) female BALB/C mice obtained from Harlan Breeding Laboratories (Indianapolis, Ind.) weighing 16-22 grams are equally distributed into three groups (10 mice/group). Mice are housed in polycarbonate mouse cages (N=5 mice per cage). Food and water are supplied ad libitum to all mice. Mice are vaccinated subcutaneously with 0.1 ml of the appropriate composition two times at 14 day intervals as follows:

Group-1: Placebo, vaccinated with ovalbumin (40 μg/100 μl)

Group-2: Vaccinated with ATCC 25904 proteins expressed under iron-restriction (40 μg/100 μl).

Group-3: Vaccinated with recombinant polypeptides SirA, SYN2, FhuD, and MntC (each 10 μg/100 μl, total protein 40 μg/100 μl).

Mice are challenged as described in Example 19. Mice in Group 3 will exhibit reduced mortality compared to mice in Group 1.

Example 23

Mouse Vaccination

Recombinantly-produced PflB polypeptide is prepared and isolated as described in Example 16.

Thirty (N=30) female BALB/C mice obtained from Harlan Breeding Laboratories (Indianapolis, Ind.) weighing 16-22 grams are equally distributed into three groups (10 mice/group). Mice are housed in polycarbonate mouse cages (N=5 mice per cage). Food and water are supplied ad libitum to all mice. Mice are vaccinated subcutaneously with 0.1 ml of the appropriate composition two times at 14 day intervals as follows:

Group-1: Placebo, vaccinated with ovalbumin (10 μg/100 μl)

Group-2: Vaccinated with ATCC 25904 proteins expressed under iron-restriction (10 μg/100 μl).

Group-3: Vaccinated with recombinant polypeptide PflB (each 10 μg/100 μl).

Mice are challenged as described in Example 19. Mice in Group 3 will exhibit reduced mortality compared to mice in Group 1.

Example 24

Mouse Vaccination

Recombinantly-produced Opp1A polypeptide is prepared and isolated as described in Example 16.

Thirty (N=30) female BALB/C mice obtained from Harlan Breeding Laboratories (Indianapolis, Ind.) weighing 16-22 grams are equally distributed into three groups (10 mice/group). Mice are housed in polycarbonate mouse cages (N=5 mice per cage). Food and water are supplied ad libitum to all mice. Mice are vaccinated subcutaneously with 0.1 ml of the appropriate composition two times at 14 day intervals as follows:

Group-1: Placebo, vaccinated with ovalbumin (10 μg/100
Group-2: Vaccinated with ATCC 25904 proteins expressed under iron-restriction (10 μg/100 μl).
Group-3: Vaccinated with recombinant polypeptide Opp1A (each 10 μg/100 μl).
Mice are challenged as described in Example 19. Mice in Group 3 will exhibit reduced mortality compared to mice in Group 1.

Example 25

Mouse Vaccination

Recombinantly-produced SirA polypeptide is prepared and isolated as described in Example 16.
Thirty (N=30) female BALB/C mice obtained from Harlan Breeding Laboratories (Indianapolis, Ind.) weighing 16-22 grams are equally distributed into three groups (10 mice/group). Mice are housed in polycarbonate mouse cages (N=5 mice per cage). Food and water are supplied ad libitum to all mice. Mice are vaccinated subcutaneously with 0.1 ml of the appropriate composition two times at 14 day intervals as follows:
Group-1: Placebo, vaccinated with ovalbumin (10 μg/100 μl)
Group-2: Vaccinated with ATCC 25904 proteins expressed under iron-restriction (10 μg/100 μl).
Group-3: Vaccinated with recombinant polypeptide SirA (each 10 μg/100 μl).
Mice are challenged as described in Example 19. Mice in Group 3 will exhibit reduced mortality compared to mice in Group 1.

Example 26

Mouse Vaccination

Recombinantly-produced SYN2 polypeptide is prepared and isolated as described in Example 16.
Thirty (N=30) female BALB/C mice obtained from Harlan Breeding Laboratories (Indianapolis, Ind.) weighing 16-22 grams are equally distributed into three groups (10 mice/group). Mice are housed in polycarbonate mouse cages (N=5 mice per cage). Food and water are supplied ad libitum to all mice. Mice are vaccinated subcutaneously with 0.1 ml of the appropriate composition two times at 14 day intervals as follows:
Group-1: Placebo, vaccinated with ovalbumin (10 μg/100 μl)
Group-2: Vaccinated with ATCC 25904 proteins expressed under iron-restriction (10 μg/100 μl).
Group-3: Vaccinated with recombinant polypeptide SYN2 (each 10 μg/100 μl).
Mice are challenged as described in Example 19. Mice in Group 3 will exhibit reduced mortality compared to mice in Group 1.

Example 27

Mouse Vaccination

Recombinantly-produced FhuD polypeptide is prepared and isolated as described in Example 16.
Thirty (N=30) female BALB/C mice obtained from Harlan Breeding Laboratories (Indianapolis, Ind.) weighing 16-22 grams are equally distributed into three groups (10 mice/group). Mice are housed in polycarbonate mouse cages (N=5 mice per cage). Food and water are supplied ad libitum to all mice. Mice are vaccinated subcutaneously with 0.1 ml of the appropriate composition two times at 14 day intervals as follows:
Group-1: Placebo, vaccinated with ovalbumin (10 μg/100 μl)
Group-2: Vaccinated with ATCC 25904 proteins expressed under iron-restriction (10 μg/100 μl).
Group-3: Vaccinated with recombinant polypeptide FhuD (each 10 μg/100 μl).
Mice are challenged as described in Example 19. Mice in Group 3 will exhibit reduced mortality compared to mice in Group 1.

Example 28

Mouse Vaccination

Recombinantly-produced SYN1 polypeptide is prepared and isolated as described in Example 16.
Thirty (N=30) female BALB/C mice obtained from Harlan Breeding Laboratories (Indianapolis, Ind.) weighing 16-22 grams are equally distributed into three groups (10 mice/group). Mice are housed in polycarbonate mouse cages (N=5 mice per cage). Food and water are supplied ad libitum to all mice. Mice are vaccinated subcutaneously with 0.1 ml of the appropriate composition two times at 14 day intervals as follows:
Group-1: Placebo, vaccinated with ovalbumin (10 μg/100 μl)
Group-2: Vaccinated with ATCC 25904 proteins expressed under iron-restriction (10 μg/100 μl).
Group-3: Vaccinated with recombinant polypeptide SYN1 (each 10 μg/100 μl).
Mice are challenged as described in Example 19. Mice in Group 3 will exhibit reduced mortality compared to mice in Group 1.

Example 29

Mouse Vaccination

Recombinantly-produced MntC polypeptide is prepared and isolated as described in Example 16.
Thirty (N=30) female BALB/C mice obtained from Harlan Breeding Laboratories (Indianapolis, Ind.) weighing 16-22 grams are equally distributed into three groups (10 mice/group). Mice are housed in polycarbonate mouse cages (N=5 mice per cage). Food and water are supplied ad libitum to all mice. Mice are vaccinated subcutaneously with 0.1 ml of the appropriate composition two times at 14 day intervals as follows:
Group-1: Placebo, vaccinated with ovalbumin (10 μg/100 μl)
Group-2: Vaccinated with ATCC 25904 proteins expressed under iron-restriction (10 μg/100 μl).
Group-3: Vaccinated with recombinant polypeptide MntC (each 10 μg/100 μl).
Mice are challenged as described in Example 19. Mice in Group 3 will exhibit reduced mortality compared to mice in Group 1.

Example 30

Mouse Vaccination

Recombinantly-produced SstD polypeptide is prepared and isolated as described in Example 16.

Thirty (N=30) female BALB/C mice obtained from Harlan Breeding Laboratories (Indianapolis, Ind.) weighing 16-22 grams are equally distributed into three groups (10 mice/group). Mice are housed in polycarbonate mouse cages (N=5 mice per cage). Food and water are supplied ad libitum to all mice. Mice are vaccinated subcutaneously with 0.1 ml of the appropriate composition two times at 14 day intervals as follows:

Group-1: Placebo, vaccinated with ovalbumin (10 μg/100 μl)

Group-2: Vaccinated with ATCC 25904 proteins expressed under iron-restriction (10 μg/100 μl).

Group-3: Vaccinated with recombinant polypeptide SstD (each 10 μg/100 μl).

Mice are challenged as described in Example 19. Mice in Group 3 will exhibit reduced mortality compared to mice in Group 1.

Example 31

Mouse Vaccination

Recombinantly-produced FhuD2 polypeptide is prepared and isolated as described in Example 16.

Thirty (N=30) female BALB/C mice obtained from Harlan Breeding Laboratories (Indianapolis, Ind.) weighing 16-22 grams are equally distributed into three groups (10 mice/group). Mice are housed in polycarbonate mouse cages (N=5 mice per cage). Food and water are supplied ad libitum to all mice. Mice are vaccinated subcutaneously with 0.1 ml of the appropriate composition two times at 14 day intervals as follows:

Group-1: Placebo, vaccinated with ovalbumin (10 μg/100 μl)

Group-2: Vaccinated with ATCC 25904 proteins expressed under iron-restriction (10 μg/100 μl).

Group-3: Vaccinated with recombinant polypeptide FhuD2 (each 10 μg/100 μl).

Mice are challenged as described in Example 19. Mice in Group 3 will exhibit reduced mortality compared to mice in Group 1.

Example 32

Recombinant Polypeptides are Specifically Bound by Sera Generated by S. aureus Infection S. aureus were prepared as challenge organisms as described in Example 4 and used to challenge mice as described in Examples 5 or 19. Sera were obtained from mice either prior to challenge or from mice which had received placebo vaccine, had been challenged with S. aureus Newman and recovered (convalescent). Blood was collected from challenged and unchallenged mice and sera were obtained by centrifugation. Sera were used to evaluate the reactivity of the individual recombinantly-produced polypeptides using an immunoblot method as described in Example 15.

Sera collected from mice prior to challenge did not react with any of the recombinant polypeptides.

Antibody in the sera produced as a result of S. aureus challenge reacted with the recombinantly-produced polypeptides as shown in FIG. 202. Antibody raised against polypeptides expressed during infection by S. aureus recognizes recombinantly-produced variants of the polypeptides. Thus, recombinant polypeptides are immunological substitutes for—e.g., immunological fragments of—immunological polypeptides expressed by the challenge S. aureus.

Example 33

Antibody Against Recombinantly-Produced Polypeptides and Iron-Regulated Membrane Polypeptides Extracted Directly from S. aureus Cells Crossreact Recombinant iron-regulated polypeptides are expressed and purified as described in Example 16. Iron-regulated membrane polypeptides are extracted directly from S. aureus cells grown in low-iron conditions as described in Example 1. The recombinant polypeptides are formulated into a vaccine as described in Example 16 and used to vaccinate mice as described in Example 17. The S. aureus-extracted polypeptides are formulated into vaccines as described in Example 2 and used to vaccinate mice as described in Example 3. For the recombinant polypeptide vaccines, a single recombinant polypeptide will be formulated into the vaccine. Antisera from vaccinated mice are collected and used for immunoblots as described in Example 15.

The antisera from animals vaccinated with recombinantly-produced iron-regulated polypeptides are further used to evaluate reactivity with extracted iron-regulated polypeptides following the separation of the extracted iron-regulated polypeptides by SDS-PAGE. Antisera from animals vaccinated with recombinant polypeptides will bind to appropriate SDS-PAGE-separated extracted polypeptides where antibody epitopes are conserved between the extracted polypeptides and the recombinantly-produced polypeptides.

The antisera from animals vaccinated with extracted iron-regulated polypeptides are further used to evaluate reactivity with individual recombinantly-produced iron-regulated polypeptides following the separation of the recombinant iron-regulated polypeptides by SDS-PAGE. Antisera from animals vaccinated with extracted polypeptides will bind to appropriate SDS-PAGE-separated recombinant polypeptides where antibody epitopes are conserved between the recombinantly-produced polypeptides and the extracted polypeptides.

Example 34

Western Blot Analysis of Recombinant S. aureus Proteins

Recombinant S. aureus proteins were prepared as described in Example 16, then subjected to sodium dodecyl sulfate-10% polyacrylamide gel electrophoresis and transferred to nitrocellulose membranes (BioRad, Hercules, Calif.) for Western blot analysis. Individual blots were reacted with serum from healthy (no reported Staphylococcus infection) or convalescent (Methicilin Resistant S. aureus) human donors.

As a control to identify each recombinant Histidine-tagged protein, each blot was co-incubated with anti-Histidine antibodies (Rockland Immunochemicals, Inc., Gilbertsville, Pa. and Qiagen GmbH, Hilden, Germany) to identify the recombinant proteins using two-color analysis. All primary antisera were used at a 1:1000 dilution and incubated for 1 hour on a rocker. Following several washes with TBS+0.05% TWEEN to remove unbound antibody, the membranes were subsequently incubated with a 800CW dye-conjugated human secondary antibody (Rockland Immunochemicals, Inc., Gilbertsville, Pa.), 680 dye-conjugated mouse secondary antibody (Li-cor Biosciences, Lincoln, Nebr.) or a 800CW dye-conjugated rabbit secondary antibody (Li-Cor Biosciences) at the dilution recommended by the manufacturer, for 1 hour, in the dark. The membranes were washed an additional three to five times with TBS+ 0.05% TWEEN with the last wash in TBS-only. Fluorescent signals (680 and 800) were detected using the ODYSSEY Infrared Imaging System (Li-Cor Biosciences). Results are shown in FIG. 203 (healthy) and FIG. 204 (convalescent).

Example 35

S. aureus DU5875 Surface Expression of Metal-Regualted Polypeptides

S. aureus strain DU5875 (cap–, spa–) was grown in iron-replete (TSB+0.3 mM ferric chloride) or iron-deplete (TSB+1 mM dipyridyl) conditions to an $OD_{600}$ of approximately 0.6.

In panels A-C of FIG. 205, S. aureus strain DU5875 was grown in iron-deplete conditions to an $OD_{600}$ of approximately 0.75 and frozen. Bacteria were thawed, washed in PBS and resuspended in PBS+1% Pig IgG+1% BSA as a blocking step. Mouse antiserum raised against FhuD, Opp1A or POB was used at a dilution of 1:100 to stain approximately $2 \times 10^6$ bacteria. Preimmune mouse serum was used as a negative control. Bacteria were then washed in blocking buffer and incubated with an AF633-conjugated goat anti-mouse secondary antibody, and analyzed on a flow cytometer. Bacteria incubated with preimmune mouse serum, at a 1:100, were used as a negative control.

In panel D of FIG. 205, S. aureus strain DU5875 was grown in iron-deplete conditions to an $OD_{600}$ of approximately 2.0 and frozen. Bacteria were thawed, washed in PBS and resuspended in PBS+0.2% Pig IgG+1% BSA as a blocking step. Mouse antiserum raised against rSIRP7 was used at a dilution of 1:50 to stain approximately $5 \times 10^7$ bacteria, with preimmune mouse serum used as a negative control. Bacteria were then washed in blocking buffer and incubated with an AF633-conjugated goat anti-mouse secondary antibody, and analyzed on a flow cytometer.

The results of this assay indicate that murine antibodies raised against the SIRP proteins bind to S. aureus cells. Cells grown under iron-deplete conditions bind more antibody than cells grown under iron-replete conditions, providing further evidence that FhuD, Opp1A, and PflB are expressed at higher levels under low-iron conditions and are antigens that can induce immunological activity against Staphylococcus spp. The increase in median fluorescence intensity (MFI) demonstrates the relative increase in fluorescence when anti-SIRP antibodies bind to S. aureus cells compared to the MFI of preimmune mouse serum. Results are shown in FIG. 205.

Example 36

A Luminex assay was used to evaluate cytokine expression by splenocytes from mice immunized with the combination (rSIRP7) of recombinant SIRP components PflB (SEQ ID NO:353), Opp1A (SEQ ID NO:364), SirA (SEQ ID NO:375), SYN2 (SEQ ID NO:386), FhuD (SEQ ID NO:397), SYN1 (SEQ ID NO:408, and MntC (SEQ ID NO:419) or placebo, then restimulated with SIRP Eextract (SIRPE) or rSIRP7. Several cytokines were upregulated upon restimulation, and the cytokine profiles induced by SIRPE and rSIRP7 restimulation were similar. The overall cytokine profile in response to rSIRP7 or SIRPE restimulation resembled that expected from a Th1/Th17-type immune response, and demonstrates that vaccination with the recombinant SIRP components induces a cellular immune response that can be measured based on cytokine expression.

Methods.

Mice were vaccinated two times, 14 days apart, with 70 μg total protein (OVA, SIRP Extract, or rSIRP7) formulated with 50% IFA. $CD4^+$ T cells were purified from splenocyte suspensions by negative selection using a $CD4^+$ T cell isolation kit and LD columns (Miltenyi Biotec, Inc., Auburn, Calif.). Briefly, biotinylated antibodies were used to label all cells except $CD4^+$ T cells, and then streptavidin-conjugated magnetic beads were used to remove these cells from the mixture with a magnetic column, leaving highly purified $CD4^+$ T cells. The resulting $CD4^+$ T cells were found to be greater than 95% pure based on CD3 and CD4 expression. Naïve splenocytes were treated with Mitomycin-C to generate mitotically inactive antigen presenting cells. $4 \times 10^5$ APC added to $5 \times 10^5$ $CD4^+$ T cells plus stimulation antigen, followed by 42 hours of incubation. Supernatants were analyzed by LUMINEX using the standard assay parameters. Results are shown in FIG. 206.

Example 37

S. aureus extracts from several strains (Newman, Reynolds) were prepared using the method described in Example 1. S. aureus cells were grown in either iron restricted media containing 1000 μm 2,2-dipyridyl (Sigma-Aldrich St. Louis, Mo.) or iron replete media containing 300 μM FeCl3 (Sigma-Aldrich St. Louis, Mo.).

Proteins within S. aureus membrane extracts from iron-replete and iron-deplete cultures were identified and quantified using ITRAQ and LCQ mass spectrometry. Amine-modified labeling of membrane extracts for iron deficient and iron replete Staphylococcus aureus Newman strain were performed with ITRAQ-8plex reagents (Applied Biosystems, Inc., Foster City, Calif.) using 40.0 μg of membrane extract (reagents 113 versus 115) according to the manufacturer's 8Plex protocol. Cation exchange chromatography was applied using an MCX column (Waters Corp., Milford, Mass.) and the peptides separated using an ULTIMATE 3000 NANO LC system (Dionex Corp. Bannockburn, Ill.) coupled to ESI mode using a QSTAR XL mass spectrometer (Applied Biosystems, Inc., Foster City, Calif.).

The ratio of metal-regulated polypeptides produced by cells grown in iron-restricted media compared to iron-replete media was measured. The ratio is a relative measure of protein expression and does not provide data indicating an absolute amount of protein present in the extract. Results are shown in Table 15.

TABLE 15

| Protein | Identified in extract | Fold increase in low iron |
|---------|----------------------|---------------------------|
| MntC    | Yes                  | 22                        |
| SYN1    | Yes                  | Not determined            |
| FhuD    | No                   | Not determined            |
| SYN2    | Yes                  | 23                        |
| SirA    | Yes                  | 36                        |
| Opp1A   | Yes                  | Not determined            |
| PflB    | Yes                  | Not determined            |
| FhuD2   | Yes                  | 6                         |
| SstD    | Yes                  | 14                        |

Example 38

An oxidative burst assay can be used to measure the production of reactive oxygen species by neutrophils, an indication of an inflammatory response. To obtain neutrophils from fresh blood, red blood cells from fresh human blood are lysed by the addition of lysis buffer (150 mM $NH_4Cl$, 10 mM $KHCO_3$, 1 mM disodium EDTA, pH 7.4) at a 1:10 dilution, incubated for 10 minutes at room temperature and centrifuged for 10 minutes at 430×g. The supernatant is removed by tube inversion and pellets are washed twice with PBS, then resuspended in 5 ml of RPMI-Hepes 5% FCS+Glutamine (complete RPMI) and enumerated using a MULTISTZER (Beckman Coulter, Inc., Brea, Calif.) after a 1/500 dilution of cell suspension in ISOTON (20 µl of cells in 10 ml ISOTON, Beckman Coulter, Inc., Brea, Calif.).

For the preparation of bacteria, *S. aureus* strain Lowenstein is seeded in TSB medium and grown for 20 hours at 37° C. in 50 ml of medium. From this culture, 5 ml are pelleted for 10 minutes at 4000 rpm at 4° C. The pellet is then washed with 50 ml of PBS and repelleted by centrifugation for 10 minutes at 4000 rpm at 4° C. The wash step is repeated and the bacterial pellet is resuspended in 5 ml of PBS. Bacteria are adjusted to a theoretical density of $1\cdot10^9$ CFU/ml and cell dilutions are plated on agar and incubated for exact enumeration the following day.

To decomplement the sera, all sera are incubated for 30 minutes at 56° C. Mixtures of sera and cells are performed in polypropylene sterile DW plates in a final volume of 500 µl per well. Into each well, the following reagents are added (as shown in Table 16), in order: culture medium (RPMI-Hepes, glutamine, 5% FCS), live bacteria at the appropriate concentration, the sera at the appropriate dilution, the complement, hPMNs at the appropriate concentration and, finally, the DHR molecule (Life Technologies, Inc., Carlsbad, Calif.) as the marker of oxidative burst. Plates are incubated for 25 minutes at 37° C. with shaking. The reaction is stopped by incubating the plates for five minutes on ice.

TABLE 16

| Reagent | Identification | Working Conc. | Vol./ well | Final concentration (in 500 µl) |
|---|---|---|---|---|
| Live bacteria | TSB, 20 h, 37° C. $10^9$ CFU/ml | $1.25 \cdot 10^8$ CFU/ml | 200 µl | $5 \cdot 10^7$ CFU/ml |
| Whole blood leukocytes | From 2 different donors after the red blood cell lysis | $2.5 \cdot 10^6$ cells/ml | 100 µl | $0.5 \cdot 10^6$ cells/ml |
| DHR | Life Technologies, Inc. Cat. No. D632 (10 mg/ml) | 100 µg/ml | 50 µl | 10 µg/ml |
| Baby rabbit complement | Produced in-house | 1/10 | 50 µl | 1/100 (1%) |
| Sera | Serum from mouse immunized with adjuvant alone | 1/10 | 50 µl | 1/100 |
|  | Anti-whole cell control | 1/100 | 50 µl | 1/1000 |
|  | Anti-*S. aureus* protein | 1/10 and 1/100 | 50 µl | 1/100 and 1/1000 |

For flow cytometric analysis, the human PMNs are first identified according to their size and granularity and then verified by surface expression of specific markers (CD35, CD16, GR1, etc.), then oxidative burst marker. The data are given in terms of percent of activated hPMNs able to induce oxidative burst in comparison with the negative control group. (Didier, 2003; Ploppa, 2008).

Example 39

Opsonophagocytic Assay

An opsonophagocytic assay (OPA) has been developed to estimate the functional phagocytic activity of serum for *Staphylococcus aureus* by measuring the complement dependent opsonic activity of the serum. The OPA is summarized on Table 17. Two strains of *S. aureus* are used in the assay. Strain DU5875, which does not produce capsule or protein A, is used to best control the assay. Strain LST4 Lowenstein, which does express capsule and protein A, is used as a wild-type strain in the assay. The number of bacteria used in the assay is dependent on the source of the effector white blood cells and ranges in concentration from $1\times10^5$ cfu/ml to $5\times10^7$ cfu/ml. White blood cells from healthy human volunteers or from a human promyelocytic leukemia cell line, HL□60, are used as phagocytic effector cells. As Table 17 indicates, the number of effector cells used in the assay is dependent on the source of the cells. Baby rabbit serum is used as a source of complement and is diluted from 1% to 10% depending on the lot of serum in order to maximize the functional complement activity of the rabbit serum while minimizing the toxicity. Sera undergoing testing for opsonic activity, pre- or post-immunization, are decomplemented at 56° C. for 30 minutes and are tested in the assay at a dilution of 1:20 to 1:2,000,000. Phagocytosis is determined by viable counts (cfu) of *S. aureus*. Test serum which demonstrates a significant loss of cfu in combination with active complement when compared to preimmune serum, is considered opsonic. The assay data are analyzed by the Student's t-Test using one-tailed distribution with unequal variance. (Kim 2010; Stranger-Jones 2006; Dryla 2005).

TABLE 17

| Reagent | Final Concentration |
|---|---|
| Live Bacteria | approx. $1 \times 10^5$ cfu/ml when using HL-60 effector cells approx. $5 \times 10^7$ cfu/ml when using healthy human WBCs |
| Effector cells | HL-60 human cell line chemically induced to differentiate with N,N-dimethylformamide diluted to $10 \times 10^6$/ml or human white blood cells from healthy volunteers diluted to $1 \times 10^7$/ml |
| Complement | Baby rabbit serum diluted from 1% to 10% according to Lot of serum |
| Test Serum | Serum obtained after the last immunization, decompelemented and serially diluted from 1:20 to 1:2,000,000 |

Example 40

Immune Mechanism Studies (In Vivo)

In another example, the immune mechanism by which vaccine proteins confer protection to mice will be assessed. These experiments can include two types: (1) using gene knockout mice in vaccine-challenge experiments to determine whether specific immune components are necessary for protection; and (2) adoptive transfer experiments, where immune cells from immunized donor mice are transferred into naïve recipients prior to bacterial challenge, in order to test whether the transferred components are sufficient to confer protection.

For examples involving vaccine challenge experiments in gene knockout mice, the mice can be purchased from commercial vendors and can include several well characterized strains such as, for example, B cell knockouts (µMT), T cell knockouts (TCRα), and a variety of cytokine knockouts, such as IFN-γ, IL-1α, TNFα, IL-17, etc.). The mice can be immunized as described in Example 3, and then challenge with *S. aureus*, as described in Example 5. The use of wild type mice with the same genetic background (Balb/c) can provide suitable controls to measure the effect of the knockout on vaccine-mediated protection against *S. aureus*. For example, if the vaccinated B cell knockout mice die more rapidly, or in larger numbers relative to the vaccinated control mice in response to bacterial challenge, it can be concluded that B cells (or their products) are important for the vaccine-mediated protection against *S. aureus*. These strategies are standard practice in the field for measuring contributions of various immune components to vaccine protection (Spellberg, 2008; Lin, 2009).

For examples involving adoptive transfer of immune components, wild type Balb/c donor mice can be immunized as described in Example 3 in order to generate tissue for adoptive transfer. These mice can then be euthanized 2-4 weeks after the second immunization and the blood collected via cardiac puncture and secondary lymphoid tissue (lymph nodes and spleen) collected. Lymph nodes collected can include: axillary, brachial, mesenteric, inguinal, superficial cervical, deep cervical, and lumbar. Serum can be isolated from the blood using standard methodology, such as centrifugation-based serum separators, and then transferred back into a separate set of recipient mice via intravenous or intraperitoneal injection. The use of 1-3 donor mice per recipient is a reasonable ratio for serum transfer, and can occur in volumes up to 0.5 ml. In addition, T cells from the donor lymphoid tissue can be purified using antibodies and magnetic bead enrichment technology (Miltenyi Biotec) that is standard practice in the field. It is typical to achieve 95-99% cell purity using these methods, as assessed by staining the cell surface proteins with antibodies to specific lineage markers and examining the cells by flow cytometry. The cell populations of interest (e.g., $CD4^+$ T cells, $CD8^+$ T cells, etc.) can be transferred back into recipient animals via intravenous injection (between 2,000,000 and 5,000,000 T cells per recipient). Recipient mice can receive T cells (or subsets of T cells), immune serum, or both.

As a negative control, placebo-immunized animals can also be used for serum and T cell isolation followed by transfer back into naïve recipients. As a positive control, a group of recipients that gets immunized with the standard protective vaccine can be included in order to provide a baseline assessment of protective efficacy upon bacterial challenge.

Once the recipient mice have received various transferred cells or sera, they can be challenged with *S. aureus* as described in Example 5. Based on the percentage of death and the rate of death, the relative contribution of various immune components to vaccine protection can be assessed. For instance, if recipients that have been administered T cells from vaccinated donors are protected against challenge at the same rate as the positive control, it can be concluded that T cells are sufficient for vaccine-mediated protection. This experimental strategy is standard practice in the field for assessing the immunological mechanisms of vaccines (Spellberg, 2008; Lin, 2009).

Example 41

Inhibition of Iron Uptake Assay

For assessing whether antibodies directed against SIRP components inhibit cell growth by blocking iron uptake, an iron uptake/transport assay can be run using bacterial cells that are pre-incubated with anti-SIRP antisera. *S. aureus* cells from any strain are grown overnight in chelated or iron-rich media. Cells are subcultured in the same media and grown to mid to late log phase, pelleted and incubated with anti-SIRP antisera or control antisera in PBS for up to one hour. Cells were then harvested by filtration using 0.45 μM filters, then resuspended in Chelex-100 treated minimal medium to eliminate environmental iron. Cells are shaken briefly. Meanwhile, an iron source (for example, ferrichrome) is mixed with radiolabeled $^{55}FeCl_2$ (or another radiolabeled iron molecule) with nitrilotriacetic acid and allowed to incubate for several minutes.

To commence iron uptake, a small aliquot (for example, 10 μl) of the radiolabeled iron mixture was added to cells (in a 1 ml volume) in a 10 ml Fe-free culture tube. The tube is incubated with periodic vortexing and sampling of aliquots filtered onto membrane filters and washed with LiCl. Following drying, membranes are counted in scintillation fluid to quantify the iron uptake. Cells pre-incubated with anti-SIRP antisera should be slower to take up iron than cells pre-incubated with control antisera (Sebulsky, 2000; Goel, 2001).

Example 42

High-Yield Protein Purification Protocol

In some instances, recombinant rSIRPs were purified using a high-yield method. This method is optimized for higher yields and higher purity of the polypeptide. The method is performed by resuspending the bacterial pellet containing the recombinant-produced polypeptide in 20 mM Tris pH 9; 300 mM NaCl complemented with lysozyme (100 μg/ml final) and $MgCl_2$ (1 mM final). The sample is then incubated with gentle rocking for 15 minutes at 4° C. After 15 minutes, 1 U/ml of benzonase is added and the sample is incubated for one hour at room temperature. The soluble lysate obtained after centrifugation (20,000×g, 20 minutes at 4° C.) should be filtered with a 0.45 μm filter and added to an equilibrated 5 ml gravity column packed with nickel-His binding resin (NOVAGEN 69670-4, EMD Chemicals, Inc., Gibbstown, N.J.). The purification of the N-$His_6$-protein is performed following manufacturer's instructions. The purification of the N-$His_6$-protein is finalized using a HILOAD 26/60 SUPERDEX 75 prep grade size-exclusion column (GE Healthcare Bioscienes, Piscataway, N.J.). The column is equilibrated with 20 mM Tris pH 9; 300 mM NaCl using a BioCAD FPLC (Applied Biosystems Inc., Foster City, Calif.) and 15 ml of the protein sample is loaded onto the HILOAD column at a flow-rate of 1.5 ml/min. The sample is eluted following 3.5 hours of run time at a flow-rate 1.8 ml/min using 20 mM Tris pH 9; 300 mM NaCl as the mobile phase.

The polypeptide is quantified using a modified version of the BCA (Thermo Fisher Scientific, Inc., Rockford, Ill.) procedure where 15% sodium dodecyl sulphate (SDS), 8M urea, and 2.5% 3-([3-Cholamidopropyl]dimethylammonio)-2-hydroxy-1-propanesulfonate (CHAPS) is used to ensure complete solubility of all protein within the sample. The assay also consists of 5% SDS added to the BCA working reagent to maintain solubility of the protein during the BCA reactive phase. The reading and analysis of the BCA is performed according to the product literature.

For densitometric analysis, 3.0 μg of final product antigen was quantified for purity using 10% SDS PAGE, stained with COOMASSIE and imaged using an ODYSSEY scanner (LiCor Biosciences, Lincoln, Nebr.). The stained gel was scanned and the areas of the major components were determined relative to the total area. Residual Endotoxin was removed using an ENDOTRAP blue one/ENDOSAFE kit (Hyglos GmbH, Regendburg, Germany). The final batch is stored with a concentration range of 1.0 mg/ml to 4.0 mg/ml in PBS storage buffer at less than −70° C. in appropriate aliquots.

The complete disclosure of all patents, patent applications, and publications, and electronically available material (including, for instance, nucleotide sequence submissions in, e.g., GenBank and RefSeq, and amino acid sequence submissions in, e.g., SwissProt, PIR, PRF, PDB, and translations from annotated coding regions in GenBank and RefSeq) cited herein are incorporated by reference. In the event that any inconsistency exists between the disclosure of the present application and the disclosure(s) of any document incorporated herein by reference, the disclosure of the present application shall govern. The foregoing detailed description and examples have been given for clarity of understanding only. No unnecessary limitations are to be understood therefrom. The invention is not limited to the exact details shown and described, for variations obvious to one skilled in the art will be included within the invention defined by the claims.

Unless otherwise indicated, all numbers expressing quantities of components, molecular weights, and so forth used in the specification and claims are to be understood as being modified in all instances by the term "about." Accordingly, unless otherwise indicated to the contrary, the numerical parameters set forth in the specification and claims are approximations that may vary depending upon the desired properties sought to be obtained by the present invention. At the very least, and not as an attempt to limit the doctrine of equivalents to the scope of the claims, each numerical parameter should at least be construed in light of the number of reported significant digits and by applying ordinary rounding techniques.

Notwithstanding that the numerical ranges and parameters setting forth the broad scope of the invention are approximations, the numerical values set forth in the specific examples are reported as precisely as possible. All numerical values, however, inherently contain a range necessarily resulting from the standard deviation found in their respective testing measurements.

All headings are for the convenience of the reader and should not be used to limit the meaning of the text that follows the heading, unless so specified.

SEQUENCE LISTING (647 sequences)

SEQ ID NO: 1 - protein, 5 aa, artificial
  polypeptide fragment included in mass fingerprint
HVDVR

SEQ ID NO: 2 - protein, 5 aa, artificial
  polypeptide fragment included in mass fingerprint
YSYER

SEQ ID NO: 3 - protein, 7 aa, artificial
  polypeptide fragment included in mass fingerprint
IIGDYRR

SEQ ID NO: 4 - protein, 7 aa, artificial
  polypeptide fragment included in mass fingerprint
IFTDYRK

SEQ ID NO: 5 - protein, 8 aa, artificial
  polypeptide fragment included in mass fingerprint
ELKELGQK

SEQ ID NO: 6 - protein, 8 aa, artificial
  polypeptide fragment included in mass fingerprint
YAQVKPIR

SEQ ID NO: 7 - protein, 8 aa, artificial
  polypeptide fragment included in mass fingerprint
QMQFFGAR

SEQ ID NO: 8 - protein, 9 aa, artificial
  polypeptide fragment included in mass fingerprint
SMQPFGGIR

SEQ ID NO: 9 - protein, 10 aa, artificial
  polypeptide fragment included in mass fingerprint
VSGYAVNFIK

SEQ ID NO: 10 - protein, 10 aa, artificial
  polypeptide fragment included in mass fingerprint
NHATAWQGFK

SEQ ID NO: 11 - protein, 10 aa, artificial
  polypeptide fragment included in mass fingerprint
LWEQVMQLSK

SEQ ID NO: 12 - protein, 11 aa, artificial
  polypeptide fragment included in mass fingerprint
SLGKEPEDQNR

SEQ ID NO: 13 - protein, 12 aa, artificial
  polypeptide fragment included in mass fingerprint
DGISNTFSIVPK

SEQ ID NO: 14 - protein, 13 aa, artificial
  polypeptide fragment included in mass fingerprint
AGVITGLPDAYGR

SEQ ID NO: 15 - protein, 11 aa, artificial
  polypeptide fragment included in mass fingerprint
TSTFLDIYAER

SEQ ID NO: 16 - protein, 12 aa, artificial
  polypeptide fragment included in mass fingerprint
SMQPFGGIRMAK

SEQ ID NO: 17 - protein, 12 aa, artificial
  polypeptide fragment included in mass fingerprint
THNQGVFDAYSR

SEQ ID NO: 18 - protein, 14 aa, artificial
  polypeptide fragment included in mass fingerprint
KAGVITGLPDAYGR

SEQ ID NO: 19 - protein, 13 aa, artificial
  polypeptide fragment included in mass fingerprint
TLLYAINGGKDEK

SEQ ID NO: 20 - protein, 12 aa, artificial
  polypeptide fragment included in mass fingerprint
IEMALHDTEIVR

SEQ ID NO: 21 - protein, 15 aa, artificial
  polypeptide fragment included in mass fingerprint
AGEPFAPGANPMHGR

SEQ ID NO: 22 - protein, 13 aa, artificial
  polypeptide fragment included in mass fingerprint
VALYGVDFLMEEK

SEQ ID NO: 23 - protein, 13 aa, artificial
  polypeptide fragment included in mass fingerprint
KTHNQGVFDAYSR

SEQ ID NO: 24 - protein, 13 aa, artificial
  polypeptide fragment included in mass fingerprint
YGFDLSRPAENFK

SEQ ID NO: 25 - protein, 13 aa, artificial
  polypeptide fragment included in mass fingerprint
TSSIQYENDDIMR

SEQ ID NO: 26 - protein, 16 aa, artificial
  polypeptide fragment included in mass fingerprint
KAGEPFAPGANPMHGR

SEQ ID NO: 27 - protein, 14 aa, artificial
  polypeptide fragment included in mass fingerprint
RVALYGVDFLMEEK

SEQ ID NO: 28 - protein, 13 aa, artificial
  polypeptide fragment included in mass fingerprint
LWEQVMQLSKEER

SEQ ID NO: 29 - protein, 16 aa, artificial
  polypeptide fragment included in mass fingerprint
MLETNKNHATAWQGFK

SEQ ID NO: 30 - protein, 17 aa, artificial
  polypeptide fragment included in mass fingerprint
MHDFNTMSTEMSEDVIR

SEQ ID NO: 31 - protein, 18 aa, artificial
  polypeptide fragment included in mass fingerprint
YGNNDDRVDDIAVDLVER

SEQ ID NO: 32 - protein, 19 aa, artificial
  polypeptide fragment included in mass fingerprint
ETLIDAMEHPEEYPQLTIR

SEQ ID NO: 33 - protein, 25 aa, artificial
  polypeptide fragment included in mass fingerprint
YAQVKPIRNEEGLVVDFEIEGDFPK

SEQ ID NO: 34 - protein, 6 aa, artificial
  polypeptide fragment included in mass fingerprint
LHSWLK

SEQ ID NO: 35 - protein, 7 aa, artificial
  polypeptide fragment included in mass fingerprint
KLHSWLK

SEQ ID NO: 36 - protein, 7 aa, artificial
  polypeptide fragment included in mass fingerprint
TYTFHLR

SEQ ID NO: 37 - protein, 9 aa, artificial
  polypeptide fragment included in mass fingerprint
KFDGTGPFK

SEQ ID NO: 38 - protein, 9 aa, artificial
  polypeptide fragment included in mass fingerprint
QAIGHMVNR

SEQ ID NO: 39 - protein, 9 aa, artificial
  polypeptide fragment included in mass fingerprint
KWDVSEDGK

SEQ ID NO: 40 - protein, 10 aa, artificial
  polypeptide fragment included in mass fingerprint
IYNSIDDAFK

SEQ ID NO: 41 - protein, 10 aa, artificial
  polypeptide fragment included in mass fingerprint
NLEMAMYYDK

SEQ ID NO: 42 - protein, 11 aa, artificial
  polypeptide fragment included in mass fingerprint
ENKQLTYTTVK

SEQ ID NO: 43 - protein, 12 aa, artificial
  polypeptide fragment included in mass fingerprint
AESLLDEAGWKK

SEQ ID NO: 44 - protein, 12 aa, artificial
  polypeptide fragment included in mass fingerprint
TVRQAIGHMVNR

SEQ ID NO: 45 - protein, 11 aa, artificial
  polypeptide fragment included in mass fingerprint
TYTFHLRDDVK

SEQ ID NO: 46 - protein, 12 aa, artificial
  polypeptide fragment included in mass fingerprint
KGETNFAFTDDR

SEQ ID NO: 47 - protein, 13 aa, artificial
  polypeptide fragment included in mass fingerprint
FHDGTPFDADAVK

SEQ ID NO: 48 - protein, 12 aa, artificial
  polypeptide fragment included in mass fingerprint
NVTDINFDMPTR

SEQ ID NO: 49 - protein, 12 aa, artificial
  polypeptide fragment included in mass fingerprint
DKIYNSIDDAFK

SEQ ID NO: 50 - protein, 12 aa, artificial
  polypeptide fragment included in mass fingerprint
EQAEYLQAEFKK

SEQ ID NO: 51 - protein, 14 aa, artificial
  polypeptide fragment included in mass fingerprint
VMPAGETAFLSMKK

SEQ ID NO: 52 - protein, 14 aa, artificial
  polypeptide fragment included in mass fingerprint
FHDGTPFDADAVKK

SEQ ID NO: 53 - protein, 13 aa, artificial
  polypeptide fragment included in mass fingerprint
NVTDINFDMPTRK

SEQ ID NO: 54 - protein, 14 aa, artificial
  polypeptide fragment included in mass fingerprint
LNINGETSDKIAER

SEQ ID NO: 55 - protein, 16 aa, artificial
  polypeptide fragment included in mass fingerprint
EILDGQEKPATQLFAK

SEQ ID NO: 56 - protein, 17 aa, artificial
  polypeptide fragment included in mass fingerprint
GSSSQKEQAEYLQAEFK

SEQ ID NO: 57 - protein, 16 aa, artificial
  polypeptide fragment included in mass fingerprint
DESADFNKNDQYWGEK

SEQ ID NO: 58 - protein, 19 aa, artificial
  polypeptide fragment included in mass fingerprint
IAKEILDGQEKPATQLFAK

SEQ ID NO: 59 - protein, 18 aa, artificial
  polypeptide fragment included in mass fingerprint
VSFTQSQYELPFNEMQYK

SEQ ID NO: 60 - protein, 22 aa, artificial
  polypeptide fragment included in mass fingerprint
EAYQPALAELAMPRPYVFVSPK

SEQ ID NO: 61 - protein, 26 aa, artificial
  polypeptide fragment included in mass fingerprint
DIGDMNPHVYGGSMSAESMIYEPLVR

SEQ ID NO: 62 - protein, 26 aa, artificial
  polypeptide fragment included in mass fingerprint
DIGDMNPHVYGGSMSAESMIYEPLVR

SEQ ID NO: 63 - protein, 9 aa, artificial
  polypeptide fragment included in mass fingerprint
IVYVGADEK

SEQ ID NO: 64 - protein, 9 aa, artificial
  polypeptide fragment included in mass fingerprint
QALNNPVLK

SEQ ID NO: 65 - protein, 10 aa, artificial
  polypeptide fragment included in mass fingerprint
ETVKIENNYK

SEQ ID NO: 66 - protein, 11 aa, artificial
  polypeptide fragment included in mass fingerprint
ENPDVILAMDR

SEQ ID NO: 67 - protein, 14 aa, artificial
  polypeptide fragment included in mass fingerprint
IAATKPEVIFISGR

SEQ ID NO: 68 - protein, 14 aa, artificial
  polypeptide fragment included in mass fingerprint
NAVVLDYGALDVMK

SEQ ID NO: 69 - protein, 13 aa, artificial
  polypeptide fragment included in mass fingerprint
ALPNFLESFKDDK

SEQ ID NO: 70 - protein, 14 aa, artificial
  polypeptide fragment included in mass fingerprint
LWYFAAGSTTTTIK

SEQ ID NO: 71 - protein, 16 aa, artificial
  polypeptide fragment included in mass fingerprint
FGGLVYDTLGFNAVDK

SEQ ID NO: 72 - protein, 16 aa, artificial
  polypeptide fragment included in mass fingerprint
IVYVGADEKNLIGSMK

SEQ ID NO: 73 - protein, 17 aa, artificial
  polypeptide fragment included in mass fingerprint
FGGLVYDTLGFNAVDKK

SEQ ID NO: 74 - protein, 18 aa, artificial
  polypeptide fragment included in mass fingerprint
GRFGGLVYDTLGFNAVDK

SEQ ID NO: 75 - protein, 18 aa, artificial
  polypeptide fragment included in mass fingerprint
TVMYLLVNEGELSTFGPK

SEQ ID NO: 76 - protein, 20 aa, artificial
  polypeptide fragment included in mass fingerprint
EVNFDKIAATKPEVIFISGR

SEQ ID NO: 77 - protein, 28 aa, artificial
  polypeptide fragment included in mass fingerprint
VSNSNHGQNVSNEYVNKENPDVILAMDR

SEQ ID NO: 78 - protein, 5 aa, artificial
  polypeptide fragment included in mass fingerprint
FEYIK

SEQ ID NO: 79 - protein, 6 aa, artificial
  polypeptide fragment included in mass fingerprint
DAWPLK

SEQ ID NO: 80 - protein, 7 aa, artificial
  polypeptide fragment included in mass fingerprint
ASVVNFR

SEQ ID NO: 81 - protein, 7 aa, artificial
  polypeptide fragment included in mass fingerprint
VYDQLSK

SEQ ID NO: 82 - protein, 9 aa, artificial
  polypeptide fragment included in mass fingerprint
HAMGTTEIK

SEQ ID NO: 83 - protein, 8 aa, artificial
  polypeptide fragment included in mass fingerprint
LIDDLYEK

SEQ ID NO: 84 - protein, 8 aa, artificial
  polypeptide fragment included in mass fingerprint
YKDAWPLK

SEQ ID NO: 85 - protein, 9 aa, artificial
  polypeptide fragment included in mass fingerprint
EKEAEDLLK

SEQ ID NO: 86 - protein, 10 aa, artificial
  polypeptide fragment included in mass fingerprint
LKPDLIVASK

SEQ ID NO: 87 - protein, 9 aa, artificial
  polypeptide fragment included in mass fingerprint
FEYIKNDLK

SEQ ID NO: 88 - protein, 10 aa, artificial
  polypeptide fragment included in mass fingerprint
KTESEWTSSK

SEQ ID NO: 89 - protein, 10 aa, artificial
  polypeptide fragment included in mass fingerprint
YDDKVAAFQK

SEQ ID NO: 90 - protein, 10 aa, artificial
  polypeptide fragment included in mass fingerprint
NEKVYDQLSK

SEQ ID NO: 91 - protein, 12 aa, artificial
  polypeptide fragment included in mass fingerprint
IAPTVSTDTVFK

SEQ ID NO: 92 - protein, 12 aa, artificial
  polypeptide fragment included in mass fingerprint
TESEWTSSKEWK

SEQ ID NO: 93 - protein, 13 aa, artificial
  polypeptide fragment included in mass fingerprint
DAWPLKASVVNFR

SEQ ID NO: 94 - protein, 14 aa, artificial
  polypeptide fragment included in mass fingerprint
QVDNGKDIIQLTSK

SEQ ID NO: 95 - protein, 13 aa, artificial
  polypeptide fragment included in mass fingerprint
LIDDLYEKLNIEK

SEQ ID NO: 96 - protein, 15 aa, artificial
  polypeptide fragment included in mass fingerprint
IVGQEPAPNLEEISK

SEQ ID NO: 97 - protein, 15 aa, artificial
  polypeptide fragment included in mass fingerprint
ESIPLMNADHIFVVK

SEQ ID NO: 98 - protein, 17 aa, artificial
  polypeptide fragment included in mass fingerprint
IYAGGYAGEILNDLGFK

SEQ ID NO: 99 - protein, 18 aa, artificial
  polypeptide fragment included in mass fingerprint
IYAGGYAGEILNDLGFKR

SEQ ID NO: 100 - protein, 20 aa, artificial
  polypeptide fragment included in mass fingerprint
NNQVSDDLDEITWNLAGGYK

SEQ ID NO: 101 - protein, 32 aa, artificial
  polypeptide fragment included in mass fingerprint
RVVTLYQGATDVAVSLGVKPVGAVESWTQKPK

SEQ ID NO: 102 - protein, 5 aa, artificial
  polypeptide fragment included in mass fingerprint
DVWAR

SEQ ID NO: 103 - protein, 6 aa, artificial
  polypeptide fragment included in mass fingerprint
IIKPVR

SEQ ID NO: 104 - protein, 10 aa, artificial
  polypeptide fragment included in mass fingerprint
IGDYTSVGTR

SEQ ID NO: 105 - protein, 10 aa, artificial
  polypeptide fragment included in mass fingerprint
KQPNLEEISK

SEQ ID NO: 106 - protein, 12 aa, artificial
  polypeptide fragment included in mass fingerprint
LKPDLIIADSSR

SEQ ID NO: 107 - protein, 11 aa, artificial
  polypeptide fragment included in mass fingerprint
VDIVDRDVWAR

SEQ ID NO: 108 - protein, 18 aa, artificial
  polypeptide fragment included in mass fingerprint
GPYLQLDTEHLADLNPER

SEQ ID NO: 109 - protein, 22 aa, artificial
  polypeptide fragment included in mass fingerprint
AGLLAHPNYSYVGQFLNELGFK

SEQ ID NO: 110 - protein, 27 aa, artificial
  polypeptide fragment included in mass fingerprint
IVVLEYSFADALAALDVKPVGIADDGK

SEQ ID NO: 111 - protein, 7 aa, artificial
  polypeptide fragment included in mass fingerprint
AGWAEVK

SEQ ID NO: 112 - protein, 9 aa, artificial
  polypeptide fragment included in mass fingerprint
TVDIPKDPK

SEQ ID NO: 113 - protein, 9 aa, artificial
  polypeptide fragment included in mass fingerprint
KDWEETTAK

SEQ ID NO: 114 - protein, 11 aa, artificial
  polypeptide fragment included in mass fingerprint
VAPTVVVDYNK

SEQ ID NO: 115 - protein, 10 aa, artificial
  polypeptide fragment included in mass fingerprint
YLEQQEMLGK

SEQ ID NO: 116 - protein, 10 aa, artificial
  polypeptide fragment included in mass fingerprint
LYTYGDNWGR

SEQ ID NO: 117 - protein, 13 aa, artificial
  polypeptide fragment included in mass fingerprint
IAVVAPTYAGGLK

SEQ ID NO: 118 - protein, 12 aa, artificial
  polypeptide fragment included in mass fingerprint
GGEVLYQAFGLK

SEQ ID NO: 119 - protein, 13 aa, artificial
  polypeptide fragment included in mass fingerprint
AGWAEVKQEEIEK

SEQ ID NO: 120 - protein, 16 aa, artificial
  polypeptide fragment included in mass fingerprint
LGANIVAVNQQVDQSK

SEQ ID NO: 121 - protein, 16 aa, artificial
  polypeptide fragment included in mass fingerprint
EKPDLIIVYSTDKDIK

SEQ ID NO: 122 - protein, 17 aa, artificial
  polypeptide fragment included in mass fingerprint
AIGQDATVSLFDEFDKK

SEQ ID NO: 123 - protein, 18 aa, artificial
  polypeptide fragment included in mass fingerprint
VDAGTYWYNDPYTLDFMR

SEQ ID NO: 124 - protein, 25 aa, artificial
  polypeptide fragment included in mass fingerprint
YAGDYIVSTSEGKPTPGYESTNMWK

SEQ ID NO: 125 - protein, 7 aa, artificial
  polypeptide fragment included in mass fingerprint
QAIEFVK

SEQ ID NO: 126 - protein, 7 aa, artificial
  polypeptide fragment included in mass fingerprint
YIAQLEK

SEQ ID NO: 127 - protein, 8 aa, artificial
  polypeptide fragment included in mass fingerprint
QGTPEQMR

SEQ ID NO: 128 - protein, 8 aa, artificial
  polypeptide fragment included in mass fingerprint
QAIEFVKK

SEQ ID NO: 129 - protein, 8 aa, artificial
  polypeptide fragment included in mass fingerprint
DKFNDIPK

SEQ ID NO: 130 - protein, 10 aa, artificial
  polypeptide fragment included in mass fingerprint
AMITSEGAFK

SEQ ID NO: 131 - protein, 11 aa, artificial
  polypeptide fragment included in mass fingerprint
SNIETVHGSMK

SEQ ID NO: 132 - protein, 11 aa, artificial
  polypeptide fragment included in mass fingerprint
HLLVETSVDKK

SEQ ID NO: 133 - protein, 13 aa, artificial
  polypeptide fragment included in mass fingerprint
DIFGEVYTDSIGK

SEQ ID NO: 134 - protein, 12 aa, artificial
  polypeptide fragment included in mass fingerprint
TIQQTFIDNDKK

SEQ ID NO: 135 - protein, 13 aa, artificial
  polypeptide fragment included in mass fingerprint
VVTTNSILYDMAK

SEQ ID NO: 136 - protein, 14 aa, artificial
  polypeptide fragment included in mass fingerprint
KDIFGEVYTDSIGK

SEQ ID NO: 137 - protein, 14 aa, artificial
  polypeptide fragment included in mass fingerprint
QDPHAWLSLDNGIK

SEQ ID NO: 138 - protein, 16 aa, artificial
  polypeptide fragment included in mass fingerprint
DVKPIYLNGEEGNKDK

SEQ ID NO: 139 - protein, 16 aa, artificial
  polypeptide fragment included in mass fingerprint
DKQDPHAWLSLDNGIK

SEQ ID NO: 140 - protein, 16 aa, artificial
  polypeptide fragment included in mass fingerprint
QYGITPGYIWEINTEK

SEQ ID NO: 141 - protein, 23 aa, artificial
  polypeptide fragment included in mass fingerprint
LTDADVILYNGLNLETGNGWFEK

SEQ ID NO: 142 - protein, 24 aa, artificial
  polypeptide fragment included in mass fingerprint
KLTDADVILYNGLNLETGNGWFEK

SEQ ID NO: 143 - protein, 27 aa, artificial
  polypeptide fragment included in mass fingerprint
NVGGDNVDIHSIVPVGQDPHEYEVKPK

SEQ ID NO: 144 - protein, 6 aa, artificial
  polypeptide fragment included in mass fingerprint
LHSWLK

SEQ ID NO: 145 - protein, 7 aa, artificial
  polypeptide fragment included in mass fingerprint
KLHSWLK

SEQ ID NO: 146 - protein, 7 aa, artificial
  polypeptide fragment included in mass fingerprint
TYTFHLR

SEQ ID NO: 147 - protein, 9 aa, artificial
  polypeptide fragment included in mass fingerprint
KFDGTGPFK

SEQ ID NO: 148 - protein, 9 aa, artificial
  polypeptide fragment included in mass fingerprint
QAIGHMVNR

SEQ ID NO: 149 - protein, 8 aa, artificial
  polypeptide fragment included in mass fingerprint
NDQYWGEK

SEQ ID NO: 150 - protein, 11 aa, artificial
  polypeptide fragment included in mass fingerprint
GTDSLDKDSLK

SEQ ID NO: 151 - protein, 10 aa, artificial
  polypeptide fragment included in mass fingerprint
IYNSIDDAFK

SEQ ID NO: 152 - protein, 10 aa, artificial
  polypeptide fragment included in mass fingerprint
DKYTVELNLK

SEQ ID NO: 153 - protein, 11 aa, artificial
  polypeptide fragment included in mass fingerprint
ISTLIDNVKVK

SEQ ID NO: 154 - protein, 12 aa, artificial
  polypeptide fragment included in mass fingerprint
AESLLDEAGWKK

SEQ ID NO: 155 - protein, 11 aa, artificial
  polypeptide fragment included in mass fingerprint
EQAEYLQAEFK

SEQ ID NO: 156 - protein, 13 aa, artificial
  polypeptide fragment included in mass fingerprint
VMPAGETAFLSMK

SEQ ID NO: 157 - protein, 12 aa, artificial
  polypeptide fragment included in mass fingerprint
KGETNFAFTDDR

SEQ ID NO: 158 - protein, 13 aa, artificial
  polypeptide fragment included in mass fingerprint
FHDGTPFDADAVK

SEQ ID NO: 159 - protein, 12 aa, artificial
  polypeptide fragment included in mass fingerprint
NVTDINFDMPTR

SEQ ID NO: 160 - protein, 12 aa, artificial
  polypeptide fragment included in mass fingerprint
EQAEYLQAEFKK

SEQ ID NO: 161 - protein, 14 aa, artificial
  polypeptide fragment included in mass fingerprint
FHDGTPFDADAVKK

SEQ ID NO: 162 - protein, 13 aa, artificial
  polypeptide fragment included in mass fingerprint
NVTDINFDMPTRK

SEQ ID NO: 163 - protein, 14 aa, artificial
  polypeptide fragment included in mass fingerprint
LNINGETSDKIAER

SEQ ID NO: 164 - protein, 16 aa, artificial
  polypeptide fragment included in mass fingerprint
EILDGQEKPATQLFAK

SEQ ID NO: 165 - protein, 16 aa, artificial
  polypeptide fragment included in mass fingerprint
DESADFNKNDQYWGEK

SEQ ID NO: 166 - protein, 18 aa, artificial
  polypeptide fragment included in mass fingerprint
VSFTQSQYELPFNEMQYK

SEQ ID NO: 167 - protein, 22 aa, artificial
  polypeptide fragment included in mass fingerprint
QIDDEGIFIPISHGSMTVVAPK

SEQ ID NO: 168 - protein, 26 aa, artificial
  polypeptide fragment included in mass fingerprint
DIGDMNPHVYGGSMSAESMIYEPLVR

SEQ ID NO: 169 - protein, 8 aa, artificial
  polypeptide fragment included in mass fingerprint
FPYAANGR

SEQ ID NO: 170 - protein, 8 aa, artificial
  polypeptide fragment included in mass fingerprint
ALLHASHR

SEQ ID NO: 171 - protein, 10 aa, artificial
  polypeptide fragment included in mass fingerprint
EEGLAIKASK

SEQ ID NO: 172 - protein, 12 aa, artificial
  polypeptide fragment included in mass fingerprint
GEAYFVDNNSLR

SEQ ID NO: 173 - protein, 13 aa, artificial
  polypeptide fragment included in mass fingerprint
TIEADYVLVTVGR

SEQ ID NO: 174 - protein, 15 aa, artificial
  polypeptide fragment included in mass fingerprint
RPNTDELGLEELGVK

SEQ ID NO: 175 - protein, 17 aa, artificial
  polypeptide fragment included in mass fingerprint
NAIIATGSRPIEIPNFK

SEQ ID NO: 176 - protein, 21 aa, artificial
  polypeptide fragment included in mass fingerprint
TSISNIYAIGDIVPGLPLAHK

SEQ ID NO: 177 - protein, 23 aa, artificial
  polypeptide fragment included in mass fingerprint
FVEAQHSENLGVIAESVSLNFQK

SEQ ID NO: 178 - protein, 26 aa, artificial
  polypeptide fragment included in mass fingerprint
VVGDFPIETDTIVIGAGPGGYVAAIR

SEQ ID NO: 179 - protein, 5 aa, artificial
  polypeptide fragment included in mass fingerprint
FEYIK

SEQ ID NO: 180 - protein, 6 aa, artificial
  polypeptide fragment included in mass fingerprint
DAWPLK

SEQ ID NO: 181 - protein, 7 aa, artificial
  polypeptide fragment included in mass fingerprint
ASVVNFR

SEQ ID NO: 182 - protein, 7 aa, artificial
  polypeptide fragment included in mass fingerprint
VYDQLSK

SEQ ID NO: 183 - protein, 8 aa, artificial
  polypeptide fragment included in mass fingerprint
LIDDLYEK

SEQ ID NO: 184 - protein, 8 aa, artificial
  polypeptide fragment included in mass fingerprint
YKDAWPLK

SEQ ID NO: 185 - protein, 9 aa, artificial
  polypeptide fragment included in mass fingerprint
EKEAEDLLK

SEQ ID NO: 186 - protein, 10 aa, artificial
  polypeptide fragment included in mass fingerprint
LKPDLIVASK

SEQ ID NO: 187 - protein, 9 aa, artificial
  polypeptide fragment included in mass fingerprint
FEYIKNDLK

SEQ ID NO: 188 - protein, 10 aa, artificial
  polypeptide fragment included in mass fingerprint
KTESEWTSSK

SEQ ID NO: 189 - protein, 10 aa, artificial
  polypeptide fragment included in mass fingerprint
YDDKVAAFQK

SEQ ID NO: 190 - protein, 12 aa, artificial
  polypeptide fragment included in mass fingerprint
IAPTVSTDTVFK

SEQ ID NO: 191 - protein, 14 aa, artificial
  polypeptide fragment included in mass fingerprint
QVDNGKDIIQLTSK

SEQ ID NO: 192 - protein, 15 aa, artificial
  polypeptide fragment included in mass fingerprint
IVGQEPAPNLEEISK

SEQ ID NO: 193 - protein, 15 aa, artificial
  polypeptide fragment included in mass fingerprint
ESIPLMNADHIFVVK

SEQ ID NO: 194 - protein, 17 aa, artificial
  polypeptide fragment included in mass fingerprint
IYAGGYAGEILNDLGFK

SEQ ID NO: 195 - protein, 18 aa, artificial
  polypeptide fragment included in mass fingerprint
IYAGGYAGEILNDLGFKR

SEQ ID NO: 196 - protein, 20 aa, artificial
  polypeptide fragment included in mass fingerprint
NNQVSDDLDEITWNLAGGYK

SEQ ID NO: 197 - protein, 31 aa, artificial
  polypeptide fragment included in mass fingerprint
VVTLYQGATDVAVSLGVKPVGAVESWTQKPK

SEQ ID NO: 198 - protein, 7 aa, artificial
  polypeptide fragment included in mass fingerprint
YIAQLEK

SEQ ID NO: 199 - protein, 8 aa, artificial
  polypeptide fragment included in mass fingerprint
QGTPEQMR

SEQ ID NO: 200 - protein, 8 aa, artificial
  polypeptide fragment included in mass fingerprint
DKFNDIPK

SEQ ID NO: 201 - protein, 10 aa, artificial
  polypeptide fragment included in mass fingerprint
AMITSEGAFK

SEQ ID NO: 202 - protein, 9 aa, artificial
  polypeptide fragment included in mass fingerprint
FNDIPKEQR

SEQ ID NO: 203 - protein, 11 aa, artificial
  polypeptide fragment included in mass fingerprint
HLLVETSVDKK

SEQ ID NO: 204 - protein, 11 aa, artificial
  polypeptide fragment included in mass fingerprint
TIQQTFIDNDK

SEQ ID NO: 205 - protein, 13 aa, artificial
  polypeptide fragment included in mass fingerprint
DIFGEVYTDSIGK

SEQ ID NO: 206 - protein, 12 aa, artificial
  polypeptide fragment included in mass fingerprint
TIQQTFIDNDKK

SEQ ID NO: 207 - protein, 13 aa, artificial
  polypeptide fragment included in mass fingerprint
VVTTNSILYDMAK

SEQ ID NO: 208 - protein, 14 aa, artificial
  polypeptide fragment included in mass fingerprint
QDPHAWLSLDNGIK

SEQ ID NO: 209 - protein, 16 aa, artificial
  polypeptide fragment included in mass fingerprint
DVKPIYLNGEEGNKDK

SEQ ID NO: 210 - protein, 16 aa, artificial
  polypeptide fragment included in mass fingerprint
DKQDPHAWLSLDNGIK

SEQ ID NO: 211 - protein, 16 aa, artificial
  polypeptide fragment included in mass fingerprint
QYGITPGYIWEINTEK

SEQ ID NO: 212 - protein, 27 aa, artificial
  polypeptide fragment included in mass fingerprint
NVGGDNVDIHSIVPVGQDPHEYEVKPK

SEQ ID NO: 213 - protein, 6 aa, artificial
  polypeptide fragment included in mass fingerprint
IIGDYR

SEQ ID NO: 214 - protein, 6 aa, artificial
  polypeptide fragment included in mass fingerprint
IFTDYR

SEQ ID NO: 215 - protein, 9 aa, artificial
  polypeptide fragment included in mass fingerprint
TGNTPDGRK

SEQ ID NO: 216 - protein, 9 aa, artificial
  polypeptide fragment included in mass fingerprint
EQQLDVISR

SEQ ID NO: 217 - protein, 10 aa, artificial
  polypeptide fragment included in mass fingerprint
LREELSEQYR

SEQ ID NO: 218 - protein, 13 aa, artificial
  polypeptide fragment included in mass fingerprint
NHATAWQGFKNGR

SEQ ID NO: 219 - protein, 16 aa, artificial
  polypeptide fragment included in mass fingerprint
DLETIVGVQTEKPFKR

SEQ ID NO: 220 - protein, 20 aa, artificial
  polypeptide fragment included in mass fingerprint
TMATGIAGLSVAADSLSAIK

SEQ ID NO: 221 - protein, 19 aa, artificial
  polypeptide fragment included in mass fingerprint
AGVITESEVQEIIDHFIMK

SEQ ID NO: 222 - protein, 23 aa, artificial
  polypeptide fragment included in mass fingerprint
FLHSLDNLGPAPEPNLTVLWSVR

SEQ ID NO: 223 - protein, 24 aa, artificial
  polypeptide fragment included in mass fingerprint
SGAQVGPNFEGINSEVLEYDEVFK

SEQ ID NO: 224 - protein, 25 aa, artificial
  polypeptide fragment included in mass fingerprint
SGAQVGPNFEGINSEVLEYDEVFKK

SEQ ID NO: 225 - protein, 30 aa, artificial
  polypeptide fragment included in mass fingerprint
VASTITSHDAGYLDKDLETIVGVQTEKPFK

SEQ ID NO: 226 - protein, 6 aa, artificial
  polypeptide fragment included in mass fingerprint
IIGDYR

SEQ ID NO: 227 - protein, 6 aa, artificial
  polypeptide fragment included in mass fingerprint
IFTDYR

SEQ ID NO: 228 - protein, 9 aa, artificial
  polypeptide fragment included in mass fingerprint
EQQLDVISR

SEQ ID NO: 229 - protein, 11 aa, artificial
  polypeptide fragment included in mass fingerprint
VDDIAVDLVER

SEQ ID NO: 230 - protein, 10 aa, artificial
  polypeptide fragment included in mass fingerprint
LREELSEQYR

SEQ ID NO: 231 - protein, 13 aa, artificial
  polypeptide fragment included in mass fingerprint
NHATAWQGFKNGR

SEQ ID NO: 232 - protein, 15 aa, artificial
  polypeptide fragment included in mass fingerprint
DLETIVGVQTEKPFK

SEQ ID NO: 233 - protein, 15 aa, artificial
  polypeptide fragment included in mass fingerprint
EAVQWLYLAYLAAIK

SEQ ID NO: 234 - protein, 16 aa, artificial
  polypeptide fragment included in mass fingerprint
DLETIVGVQTEKPFKR

SEQ ID NO: 235 - protein, 20 aa, artificial
  polypeptide fragment included in mass fingerprint
TMATGIAGLSVAADSLSAIK

SEQ ID NO: 236 - protein, 17 aa, artificial
  polypeptide fragment included in mass fingerprint
NEEGLVVDFEIEGDFPK

SEQ ID NO: 237 - protein, 19 aa, artificial
  polypeptide fragment included in mass fingerprint
AGVITESEVQEIIDHFIMK

SEQ ID NO: 238 - protein, 23 aa, artificial
  polypeptide fragment included in mass fingerprint
FLHSLDNLGPAPEPNLTVLWSVR

SEQ ID NO: 239 - protein, 24 aa, artificial
  polypeptide fragment included in mass fingerprint
SGAQVGPNFEGINSEVLEYDEVFK

SEQ ID NO: 240 - protein, 25 aa, artificial
  polypeptide fragment included in mass fingerprint
SGAQVGPNFEGINSEVLEYDEVFKK

SEQ ID NO: 241 - protein, 26 aa, artificial
  polypeptide fragment included in mass fingerprint
EFIQLNYTLYEGNDSFLAGPTEATSK

SEQ ID NO: 242 - protein, 30 aa, artificial; identical to SEQ ID NO: 225
  polypeptide fragment included in mass fingerprint

SEQ ID NO: 243 - protein, 32 aa, artificial
  polypeptide fragment included in mass fingerprint
TPDYNELFSGDPTWVTESIGGVGIDGRPLVTK

SEQ ID NO: 244 - protein, 6 aa, artificial
  polypeptide fragment included in mass fingerprint
LPDNFK

SEQ ID NO: 245 - protein, 6 aa, artificial
  polypeptide fragment included in mass fingerprint
IIGDYR

SEQ ID NO: 246 - protein, 6 aa, artificial
  polypeptide fragment included in mass fingerprint
IFTDYR

SEQ ID NO: 247 - protein, 7 aa, artificial
  polypeptide fragment included in mass fingerprint
YGNNDDR

SEQ ID NO: 248 - protein, 10 aa, artificial
  polypeptide fragment included in mass fingerprint
TLLYAINGGK

SEQ ID NO: 249 - protein, 9 aa, artificial
  polypeptide fragment included in mass fingerprint
EQQLDVISR

SEQ ID NO: 250 - protein, 10 aa, artificial
  polypeptide fragment included in mass fingerprint
LREELSEQYR

SEQ ID NO: 251 - protein, 12 aa, artificial
  polypeptide fragment included in mass fingerprint
IEMALHDTEIVR

SEQ ID NO: 252 - protein, 13 aa, artificial
  polypeptide fragment included in mass fingerprint
VSGYAVNFIKLTR

SEQ ID NO: 253 - protein, 15 aa, artificial
  polypeptide fragment included in mass fingerprint
AGEPFAPGANPMHGR

SEQ ID NO: 254 - protein, 13 aa, artificial
  polypeptide fragment included in mass fingerprint
VALYGVDFLMEEK

SEQ ID NO: 255 - protein, 16 aa, artificial
  polypeptide fragment included in mass fingerprint
KAGEPFAPGANPMHGR

SEQ ID NO: 256 - protein, 14 aa, artificial
  polypeptide fragment included in mass fingerprint
TSTFLDIYAERDLK

SEQ ID NO: 257 - protein, 15 aa, artificial
  polypeptide fragment included in mass fingerprint
VDDIAVDLVERFMTK

SEQ ID NO: 258 - protein, 20 aa, artificial
  polypeptide fragment included in mass fingerprint
TMATGIAGLSVAADSLSAIK

SEQ ID NO: 259 - protein, 20 aa, artificial
  polypeptide fragment included in mass fingerprint
DSEHTMSVLTITSNVVYGKK

SEQ ID NO: 260 - protein, 23 aa, artificial
  polypeptide fragment included in mass fingerprint
FLHSLDNLGPAPEPNLTVLWSVR

SEQ ID NO: 261 - protein, 24 aa, artificial
  polypeptide fragment included in mass fingerprint
SGAQVGPNFEGINSEVLEYDEVFK

SEQ ID NO: 262 - protein, 24 aa, artificial
  polypeptide fragment included in mass fingerprint
NLTSMLDGYAMQCGHHLNINVFNR

SEQ ID NO: 263 - protein, 25 aa, artificial
  polypeptide fragment included in mass fingerprint
SGAQVGPNFEGINSEVLEYDEVFKK

SEQ ID NO: 264 - protein, 27 aa, artificial
  polypeptide fragment included in mass fingerprint
DEKSGAQVGPNFEGINSEVLEYDEVFK

SEQ ID NO: 265 - protein, 32 aa, artificial; identical to SEQ ID NO: 243
  polypeptide fragment included in mass fingerprint

SEQ ID NO: 266 - protein, 6 aa, artificial
  polypeptide fragment included in mass fingerprint
AKSNSK

SEQ ID NO: 267 - protein, 7 aa, artificial
  polypeptide fragment included in mass fingerprint
TFYPEAR

SEQ ID NO: 268 - protein, 8 aa, artificial
  polypeptide fragment included in mass fingerprint
QFWGHLVK

SEQ ID NO: 269 - protein, 9 aa, artificial
  polypeptide fragment included in mass fingerprint
WIPLMMKGR

SEQ ID NO: 270 - protein, 10 aa, artificial
  polypeptide fragment included in mass fingerprint
VINEEFEISK

SEQ ID NO: 271 - protein, 11 aa, artificial
  polypeptide fragment included in mass fingerprint
NEDWQLYTAGK

SEQ ID NO: 272 - protein, 13 aa, artificial
  polypeptide fragment included in mass fingerprint
TLLFGPFANVGPK

SEQ ID NO: 273 - protein, 12 aa, artificial
  polypeptide fragment included in mass fingerprint
LDRPAIESSNER

SEQ ID NO: 274 - protein, 14 aa, artificial
  polypeptide fragment included in mass fingerprint
IDEGTDVNFGELTR

SEQ ID NO: 275 - protein, 13 aa, artificial
  polypeptide fragment included in mass fingerprint
EFINPLPHISYVR

SEQ ID NO: 276 - protein, 13 aa, artificial
  polypeptide fragment included in mass fingerprint
EIEPDWNIHVYER

SEQ ID NO: 277 - protein, 16 aa, artificial
  polypeptide fragment included in mass fingerprint
EPPGTPPMTVPHLDTR

SEQ ID NO: 278 - protein, 20 aa, artificial
  polypeptide fragment included in mass fingerprint
QVTDYVFIGAGGGAIPLLQK

SEQ ID NO: 279 - protein, 18 aa, artificial
  polypeptide fragment included in mass fingerprint
TFYPEARNEDWQLYTAGK

SEQ ID NO: 280 - protein, 26 aa, artificial
  polypeptide fragment included in mass fingerprint
HLGGFPISGQFLACTNPQVIEQHDAK

SEQ ID NO: 281 - protein, 5 aa, artificial
  polypeptide fragment included in mass fingerprint
FEYIK

SEQ ID NO: 282 - protein, 6 aa, artificial
  polypeptide fragment included in mass fingerprint
DAWPLK

SEQ ID NO: 283 - protein, 7 aa, artificial
  polypeptide fragment included in mass fingerprint
ASVVNFR

SEQ ID NO: 284 - protein, 7 aa, artificial
  polypeptide fragment included in mass fingerprint
VYDQLSK

SEQ ID NO: 285 - protein, 8 aa, artificial
  polypeptide fragment included in mass fingerprint
LIDDLYEK

SEQ ID NO: 286 - protein, 8 aa, artificial
  polypeptide fragment included in mass fingerprint
YKDAWPLK

SEQ ID NO: 287 - protein, 10 aa, artificial
  polypeptide fragment included in mass fingerprint
LKPDLIVASK

SEQ ID NO: 288 - protein, 12 aa, artificial
  polypeptide fragment included in mass fingerprint
IAPTVSTDTVFK

SEQ ID NO: 289 - protein, 15 aa, artificial
  polypeptide fragment included in mass fingerprint
IVGQEPAPNLEEISK

SEQ ID NO: 290 - protein, 15 aa, artificial
  polypeptide fragment included in mass fingerprint
ESIPLMNADHIFVVK

SEQ ID NO: 291 - protein, 17 aa, artificial
  polypeptide fragment included in mass fingerprint
IYAGGYAGEILNDLGFK

SEQ ID NO: 292 - protein, 18 aa, artificial
  polypeptide fragment included in mass fingerprint
IYAGGYAGEILNDLGFKR

SEQ ID NO: 293 - protein, 20 aa, artificial
  polypeptide fragment included in mass fingerprint
NNQVSDDLDEITWNLAGGYK

SEQ ID NO: 294 - protein, 31 aa, artificial; identical to SEQ ID NO: 197
  polypeptide fragment included in mass fingerprint

SEQ ID NO: 295 - protein, 5 aa, artificial
  polypeptide fragment included in mass fingerprint
DVWAR

SEQ ID NO: 296 - protein, 6 aa, artificial
  polypeptide fragment included in mass fingerprint
KLNAVK

SEQ ID NO: 297 - protein, 6 aa, artificial
  polypeptide fragment included in mass fingerprint
VDIVDR

SEQ ID NO: 298 - protein, 6 aa, artificial
  polypeptide fragment included in mass fingerprint
IIKPVR

SEQ ID NO: 299 - protein, 8 aa, artificial
  polypeptide fragment included in mass fingerprint
IAPTLSLK

SEQ ID NO: 300 - protein, 7 aa, artificial
  polypeptide fragment included in mass fingerprint
QNINSFK

SEQ ID NO: 301 - protein, 10 aa, artificial
  polypeptide fragment included in mass fingerprint
IGDYTSVGTR

SEQ ID NO: 302 - protein, 9 aa, artificial
  polypeptide fragment included in mass fingerprint
MIIMTDHAK

SEQ ID NO: 303 - protein, 10 aa, artificial
  polypeptide fragment included in mass fingerprint
KQPNLEEISK

SEQ ID NO: 304 - protein, 12 aa, artificial
  polypeptide fragment included in mass fingerprint
LKPDLIIADSSR

SEQ ID NO: 305 - protein, 11 aa, artificial
  polypeptide fragment included in mass fingerprint
VDIVDRDVWAR

SEQ ID NO: 306 - protein, 14 aa, artificial
  polypeptide fragment included in mass fingerprint
LKPDLIIADSSRHK

SEQ ID NO: 307 - protein, 18 aa, artificial
  polypeptide fragment included in mass fingerprint
GPYLQLDTEHLADLNPER

SEQ ID NO: 308 - protein, 22 aa, artificial
  polypeptide fragment included in mass fingerprint
AGLLAHPNYSYVGQFLNELGFK

SEQ ID NO: 309 - protein, 27 aa, artificial
  polypeptide fragment included in mass fingerprint
IVVLEYSFADALAALDVKPVGIADDGK

SEQ ID NO: 310 - protein, 28 aa, artificial
  polypeptide fragment included in mass fingerprint
IVVLEYSFADALAALDVKPVGIADDGKK

SEQ ID NO: 311 - protein, 9 aa, artificial
  polypeptide fragment included in mass fingerprint
AAAIDLAGR

SEQ ID NO: 312 - protein, 9 aa, artificial
  polypeptide fragment included in mass fingerprint
NIEADTGMR

SEQ ID NO: 313 - protein, 10 aa, artificial
  polypeptide fragment included in mass fingerprint
VVDANIAAQR

SEQ ID NO: 314 - protein, 9 aa, artificial
  polypeptide fragment included in mass fingerprint
ADIDLPFER

SEQ ID NO: 315 - protein, 13 aa, artificial
  polypeptide fragment included in mass fingerprint
LVGGAGEETIIAR

SEQ ID NO: 316 - protein, 13 aa, artificial
  polypeptide fragment included in mass fingerprint
AMAVATEQEMKAR

SEQ ID NO: 317 - protein, 14 aa, artificial
  polypeptide fragment included in mass fingerprint
HHTEVLENPDNISK

SEQ ID NO: 318 - protein, 17 aa, artificial
  polypeptide fragment included in mass fingerprint
VVEAESEVPLAMAEALR

SEQ ID NO: 319 - protein, 18 aa, artificial
  polypeptide fragment included in mass fingerprint
VIETPFIAGVAMNGIEVK

SEQ ID NO: 320 - protein, 22 aa, artificial
  polypeptide fragment included in mass fingerprint
AGLALTTNQLESHYLAGGNVDR

SEQ ID NO: 321 - protein, 27 aa, artificial
  polypeptide fragment included in mass fingerprint
TVLSKGLDSGTAFEILSIDIADVDISK

SEQ ID NO: 322 - protein, 32 aa, artificial
  polypeptide fragment included in mass fingerprint
AGLALTTNQLESHYLAGGNVDRVVDANIAAQR

SEQ ID NO: 323 - protein, 5 aa, artificial
  polypeptide fragment included in mass fingerprint
ADYEK

SEQ ID NO: 324 - protein, 7 aa, artificial
  polypeptide fragment included in mass fingerprint
YIAQLEK

SEQ ID NO: 325 - protein, 8 aa, artificial
  polypeptide fragment included in mass fingerprint
QGTPEQMR

SEQ ID NO: 326 - protein, 10 aa, artificial
  polypeptide fragment included in mass fingerprint
ALEQAGKSLK

SEQ ID NO: 327 - protein, 11 aa, artificial
  polypeptide fragment included in mass fingerprint
HLLVETSVDKK

SEQ ID NO: 328 - protein, 13 aa, artificial
  polypeptide fragment included in mass fingerprint
DIFGEVYTDSIGK

SEQ ID NO: 329 - protein, 12 aa, artificial
  polypeptide fragment included in mass fingerprint
TIQQTFIDNDKK

SEQ ID NO: 330 - protein, 13 aa, artificial
  polypeptide fragment included in mass fingerprint
VVTTNSILYDMAK

SEQ ID NO: 331 - protein, 14 aa, artificial
  polypeptide fragment included in mass fingerprint
KDIFGEVYTDSIGK

SEQ ID NO: 332 - protein, 14 aa, artificial
  polypeptide fragment included in mass fingerprint
DVKPIYLNGEEGNK

SEQ ID NO: 333 - protein, 14 aa, artificial
  polypeptide fragment included in mass fingerprint
QDPHAWLSLDNGIK

SEQ ID NO: 334 - protein, 16 aa, artificial
  polypeptide fragment included in mass fingerprint
DVKPIYLNGEEGNKDK

SEQ ID NO: 335 - protein, 16 aa, artificial
  polypeptide fragment included in mass fingerprint
DKQDPHAWLSLDNGIK

SEQ ID NO: 336 - protein, 16 aa, artificial
  polypeptide fragment included in mass fingerprint
QYGITPGYIWEINTEK

SEQ ID NO: 337 - protein, 20 aa, artificial
  polypeptide fragment included in mass fingerprint
VIAVSKDVKPIYLNGEEGNK

SEQ ID NO: 338 - protein, 23 aa, artificial
  polypeptide fragment included in mass fingerprint
LTDADVILYNGLNLETGNGWFEK

SEQ ID NO: 339 - protein, 27 aa, artificial
  polypeptide fragment included in mass fingerprint
NVGGDNVDIHSIVPVGQDPHEYEVKPK

SEQ ID NO: 340 - protein, 5 aa, artificial
  polypeptide fragment included in mass fingerprint
ADYEK

SEQ ID NO: 341 - protein, 7 aa, artificial
  polypeptide fragment included in mass fingerprint
YIAQLEK

SEQ ID NO: 342 - protein, 11 aa, artificial
  polypeptide fragment included in mass fingerprint
HLLVETSVDKK

SEQ ID NO: 343 - protein, 13 aa, artificial
  polypeptide fragment included in mass fingerprint
DIFGEVYTDSIGK

SEQ ID NO: 344 - protein, 12 aa, artificial
  polypeptide fragment included in mass fingerprint
TIQQTFIDNDKK

SEQ ID NO: 345 - protein, 13 aa, artificial
  polypeptide fragment included in mass fingerprint
VVTTNSILYDMAK

SEQ ID NO: 346 - protein, 14 aa, artificial
  polypeptide fragment included in mass fingerprint
DVKPIYLNGEEGNK

SEQ ID NO: 347 - protein, 14 aa, artificial
  polypeptide fragment included in mass fingerprint
QDPHAWLSLDNGIK

SEQ ID NO: 348 - protein, 16 aa, artificial
  polypeptide fragment included in mass fingerprint
DVKPIYLNGEEGNKDK

SEQ ID NO: 349 - protein, 16 aa, artificial
  polypeptide fragment included in mass fingerprint
DKQDPHAWLSLDNGIK

SEQ ID NO: 350 - protein, 16 aa, artificial
  polypeptide fragment included in mass fingerprint
QYGITPGYIWEINTEK

SEQ ID NO: 351 - protein, 23 aa, artificial
  polypeptide fragment included in mass fingerprint
LTDADVILYNGLNLETGNGWFEK

SEQ ID NO: 352 - protein, 27 aa, artificial
  polypeptide fragment included in mass fingerprint
NVGGDNVDIHSIVPVGQDPHEYEVKPK

SEQ ID NO: 353 - protein, 748 aa, Staphylococcus aureus
LETNKNHATAWQGFKNGRWNRHVDVREFIQLNYTLYEGNDSFLAGPTEATSKLWEQVMQLSKEERERGGMWDMDTKVASTITSHDAGYLDKDLETIVGVQTEKPFKRSMQPFGGIRMAKAACEAYGYELDEETEKIFTDYRKTHNQGVFDAYSREMLNCRKAGVITGLPDAYGRGRIIGDYRRVALYGVDFLMEEKMHDFNTMSTEMSEDVIRLREELSEQYRALKELKELGQKYGFDLSRPAENFKEAVQWLYLAYLAAIKEQNGAAMSLGRTSTYLDIYAERDLKAGVITESEVQEIIDHFIMKLRIVKFARTPDYNELFSGDPTWVTVSIGGVGIDGRPLVTKNSFRFLHSLDNLGPAPEPNLTVLWSVRLPDNFKTYCAKMSIKTSSIQYENDDIMRESYGDDYGIACCVSAVTIGKQMQFFGARANIAKTLLYAINGGKDEKSGAQVGPNFEGINSEVLEYDEVFKKFDQMMDWLAGVYINSLNVIHYMHDKYSYERIEMALHDTEIVRTMATGIAGLSVAADSLSAIKYAQVKPIRNEEGLVVDFEIEGDFPKYGNNDDRVDDIAVDLVERFMTKLRSHKTYRDSEHTMSVLTITSNVVYVKKTGNTPDGRKAGEPFAPGANPMHGRDQKGALSSLSSVAKIPYDCCKDGISNTFSIVPKSLGKEPEDQNRNLTSMLDGYAMQCGHHLNINVFNRETLIDAMEHPEEYPQLTIRVSGYAVNFIKLTREQQLDVISRTFHESM

SEQ ID NO: 354 - protein, 749 aa, Staphylococcus aureus
MLETNKNHATAWQGFKNGRWNRHVDVREFIQLNYTLYEGNDSFLAGPTEATSKLWEQVMQLSKEERERGGMWDMDTKVASTITSHDAGYLDKDLETIVGVQTEKPFKRSMQPFGGIRMAKAACEAYGYELDEETEKIFTDYRKTHNQGVFDAYSREMLNCRKAGVITGLPDAYGRGRIIGDYRRVALYGVDFLMEEKMHDFNTMSTEMSEDVIRLREELSEQYRALKELKELGQKYGFDLSRPAENFKEAVQWLYLAYLAAIKEQNGAAMSLGRTSTFLDIYAERDLKAGVITESEVQEIIDHFIMKLRIVKFARTPDYNELFSGDPTWVTESIGGVGIDGRPLVTKNSFRFLHSLDNLGPAPEPNLTVLWSVRLPDNFKTYCAKMSIKTSSIQYENDDIMRESYGDDYGIACCVSAMTIGKQMQFFGARANLAKTLLYAINGGKDEKSGAQVGPNFEGINSEVLEYDEVFKKFDQMMDWLAGVYINSLNVIHYMHDKYSYERIEMALHDTEIVRTMATGIAGLSVAADSLSAIKYAQVKPIRNEEGLVVDFEIEGDFPKYGNNDDRVDDIAVDLVERFMTKLRSHKTYRDSEHTMSVLTITSNVVYGKKTGNTPDGRKAGEPFAPGANPMHGRDQKGALSSLSSVAKIPYDCCKDGISNTFSIVPKSLGKEPEDQNRNLTSMLDGYAMQCGHHLNINVFNRETLIDAMEHPEEYPQLTIRVSGYAVNFIKLTREQQLDVISRTFHESM

SEQ ID NO: 355 - protein, 749 aa, Staphylococcus aureus; identical to SEQ ID NO: 354

SEQ ID NO: 356 - protein, 749 aa, Staphylococcus aureus; identical to SEQ ID NO: 354

SEQ ID NO: 357 - protein, 749 aa, Staphylococcus aureus; identical to SEQ ID NO: 354

SEQ ID NO: 358 - protein, 749 aa, Staphylococcus aureus; identical to SEQ ID NO: 354

SEQ ID NO: 359 - protein, 749 aa, Staphylococcus aureus; identical to SEQ ID NO: 354

SEQ ID NO: 360 - protein, 749 aa, Staphylococcus aureus; identical to SEQ ID NO: 354

SEQ ID NO: 361 - protein, 749 aa, Staphylococcus aureus; identical to SEQ ID NO: 354

SEQ ID NO: 362 - protein, 749 aa, Staphylococcus aureus; identical to SEQ ID NO: 354

SEQ ID NO: 363 - protein, 749 aa, Staphylococcus aureus; identical to SEQ ID NO: 354

SEQ ID NO: 364 - protein, 500 aa, Staphylococcus aureus
KKENKQLTYTTVKDIGDMNPHVYGGSMSAESMIYEPLVRNTKDGIKPLLAKKWGVSEDGKTYTFHLRDDVKFHDGTPFDADAVKKNIDAVQENKKLHSWLKISTLIDNVKVKDKYTVELNLKEAYQPALAELAMPRPYVFVSPKDFKNGTTKDGVKKFDGTGPFKLGEHKKDESADFNKNDQYWGEKSKLNKVQAKVMPAGETAFLSMKKGETNFAFTDDGGTDSLDKDSLKQLKDTGDYQVKRSQPMNTKMLVVNSGKKDNAVSDKTVRQAIGHMVNRDKIAKEILDGQEKPATQLFAKNVTDINFDMPTRKYDLKKAESLLDEAGWKKGKDSDVRQKDGKNLEMAMYYDKGSSSQKEQAEYLQAEFKKMGIKLNINGETSDKIAERRTSGDYDLMFNQTWGLLYDPQSTIAAFKAKNGMKVQHQALRIKIKYTTALMTHLKSKTVKSVQTLIKTFNKLMMKVSLSLFHTVVQLLRRKIKKYHSHNHSTNYHSMKCSIN

SEQ ID NO: 365 - protein, 532 aa, Staphylococcus aureus
MRKLTKMSAMLLASGLILTGCGGNKGLEEKKENKQLTYTTVKDIGDMNPHVYGGSMSAESMIYEPLVRNTKDGIKPLLAKKWDVSEDGKTYTFHLRDDVKFHDGTPFDADAVKKNIDAVQENKKLHSWLKISTLIDNVKVKDKYTVELNLKEAYQPALAELAMPRPYVFVSPKDFKNGTTKDGVKKFDGTGPFKLGEHKKDESADFNKNDQYWGEKSKLNKVQAKVMPAGETAFLSMKKGETNFAFTDDRGTDSLDKDSLKQLKDTGDYQVKRSQPMNTKMLVVNSGKKDSAVSDKTVRQAIGHMVNRDKIAKEILDGQEKPATQLFAKNVTDINFDMPTRKYDLKKAESLLDEAGWKKGKDSDVRQKDGKNLEMAMYYDKGSSSQKEQAEYLQAEFKKMGIKLNINGETSDKIAERRTSGDYDLMFNQTWGLLYDPQSTIAAFKAKNGYESATSGIENKDKIYNSIDDAFKIQNGKERSDAYKNILKQVNDEGIFIPISHGSMTVVAPKDLEKVSFTQSQYELPFNEMQYK

SEQ ID NO: 366 - protein, 532 aa, Staphylococcus aureus
MRKLTKMSAMLLASGLILTGCGGNKGLEEKKENKQLTYTTVKDIGDMNPHVYGGSMSAESMIYEPLVRNTKDGIKPLLAKKWDVSEDGKTYTFHLRDDVKFHDGTTFDADAVKKNIDAVQQNKKLHSWLKISTLIDNVKVKDKYTVELNLKEAYQPALAELAMPRPYVFVSPKDFKNGTTKDGVKKFDGTGPFKLGEHKKDESADFNKNDQYWGEKSKLNKVQAKVMPAGETAFLSMKKGETNFAFTDDRGTDSLDKDSLKQLKDTGDYQVKRSQPMNTKMLVVNSGKKDNAVSDKTVRQAIGHMVNRDKIAKEILDGQEKPATQLFAKNVTDINFDMPTRKYDLKKAESLLDEAGWKKGKDSDVRQKDGKNLEMAMYYDKGSSSQKEQAEYLQAEFKKMGIKLNINGETSDKIAERRTSGDYDLMFNQTWGLLYDPQSTIAAFKAKNGYESATSGIENKDKIYNSIDDAFKIQNGKERSDAYKNILKQIDDEGIFIPISHGSMTVVAPKDLEKVSFTQSQYELPFNEMQYK

SEQ ID NO: 367 - protein, 532 aa, Staphylococcus aureus
MRKLTKMSAMLLASGLILTGCGGNKGLEEKKENKQLTYTTVKDIGDMNPHVYGGSMSAESMIYEPLVRNTKDGIKPLLAKKWDVSEDGKTYTFHLRDDVKFHDGTPFDADAVKKNIDAVQENKKLHSWLKISTLIDNVKVKDKYTVELNLKEAYQPALAELAMPRPYVFVSPKDFKNGTTKDGVKKFDGTGPFKLGEHKKDESADFNKNDQYWGEKSKLNKVQAKVMPAGETAFLSMKKGETNFAFTDDRGTDSLDKDSLKQLKDTGDYQVKRSQPMNTKMLVVNSGKKDNAVSDKTVRQAIGHMVNRDKIAKEILDGQEKPATQLFAKNVTDINFDMPTRKYDLKKAESLLDEAGWKKGKDSDVRQKDGKNLEMAMYYDKGSSSQKEQAEYLQAEFKKMGIKLNINGETSDKIAERRTSGDYDLMFNQTWGLLYDPQSTIAAFKAKNGYESATSGIENKDKIYNSIDDAFKIQNGKERSDAYKNILKQIDDEGIFIPISHGSMTVVAPKDLEKVAFTQSQYELPFNEMQYK

SEQ ID NO: 368 - protein, 532 aa, Staphylococcus aureus
MRKLTKMSAMLLASGLILTGCGGNKGLEEKKENKQLTYTTVKDIGDMNPHVYGGSMSAESMIYEPLVRNTKDGIKPLLAKKWDVSEDGKTYTFHLRDDVKFHDGTPFDADAVKKNIDAVQQNKKLHSWLKISTLIDNVKVKDKYTVELNLKEAYQPALAELAMPRPYVFVSPKDFKNGTTKDGVKKFDGTGPFKLGEHKKDESADFNKNDQYWGEKSKLNKVQAKVMPAGETAFLSMKKGETNFAFTDDRGTDSLDKDSLKQLKDTGDYQVKRSQPMNTKMLVVNSGKKDNAVSDKTVRQAIGHMVNRDKIAKEILDGQEKPATQLFAKNVTDINFDMPTRKYDLKKAESLLDEAGWKKGKDSDVRQKDGKNLEMAMYYDKGSSSQKEQAEYLQAEFKKMGIKLNINGETSDKIAERRTSGDYDLMFNQTWGLLYDPQSTIAAFKAKNGYESATSGIENKDKIYNSIDDAFKIQNGKERSGAYKNILKQIDDEGIFIPISHGSMTVVAPKDLEKVSFTQSQYELPFNEMQYK

SEQ ID NO: 369 - protein, 532 aa, Staphylococcus aureus
MRKLTKMSAMLLASGLILTGCGGNKGLEEKKENKQLTYTTVKDIGDMNPHVYGGSMSAESMIYEPLVRNTKDGIKPLLAKKWDVSEDGKTYTFHLRDDVKFHDGTPFDADAVKKNIDAVQENKKLHSWLKISTLIDNVKVKDKYTVELNLKEAYQPALAELAMPRPYVFVSPKDFKNGTTKDGVKKFDGTGPFKLGEHKKDESADFNKNDQYWGEKSKLNKVQAKVMPAGETAFLSMKKGETNFAFTDDRGTDSLDKDSLKQLKDTGDYQVKRSQPMNTKMLVVNSGKKDNAVSDKTVRQAIGHMVNRDKIAKEILDGQEKPATQLFAKNVTDINFDMPTRKYDLKKAESLLDEAGWKKGKDSDVRQKDGKNLEMAMYYDKGSSSQKEQAEYLQAEFKKMGIKLNINGETSDKIAERRTSGDYDLMFNQTWGLLYDPQSTIAAFKAKNGYESATSGIENKDKIYNSIDDAFKIQNGKERSDAYKNILKQIDDEGIFIPISHGSMTVVAPKDLEKVSFTQSQYELPFNEMQYK

SEQ ID NO: 370 - protein, 532 aa, Staphylococcus aureus; identical to SEQ ID NO: 366

SEQ ID NO: 371 - protein, 532 aa, Staphylococcus aureus; identical to SEQ ID NO: 369

SEQ ID NO: 372 - protein, 532 aa, Staphylococcus aureus
MRKLTKMSAMLLTSGLILTGCGGNKGLEEKKENKQLTYTTVKDIGDMNPHVYGGSMSAESMIYEPLVRNTKDGIKPLLAKKWDVSEDGKTYTFHLRDDVKFHDGTPFDADAVKKNIDAVQENKKLHSWLKISTLIDNVKVKDKYTVELNLKEAYQPALAELAMPRPYVFVSPKDFKNGTTKDGVKKFDGTGPFKLGEHKKDESADFNKNDQYWGEKSKLNKVQAKVMPAGETAFLSMKKGETNFAFTDDRGTDSLDKDSLKQLKDTGDYQVKRSQPMNTKMLVVNSGKKDNAVSDKTVRQAIGHMVNRDKIAKEILDGQEKPATQLFAKNVTDINFDMPTRKYDLKKAESLLDEAGWKKGKDSDVRQKDGKNLEMAMYYDKGSSSQKEQAEYLQAEFKKMGIKLNINGETSDKIAERRTSGDYDLMFNQTWGLLYDPQSTIAAFKAKNGYESATSGIENKDKIYNSIDDAFKIQNGKERSDAYKNILKQIDDEGIFIPISHGSMTVVAPKDLEKVSFTQSQYELPFNEMQYK

SEQ ID NO: 373 - protein, 532 aa, Staphylococcus aureus
MRKLTKMSAMLLASGLILTGCGGNKGLEEKKENKQLTYTTVKDIGDMNPHVYGGSMSAESMIYEPLVRNTKDGIKPLLAKKWDVSEDGKTYTFHLRDDVKFHDGTPFDADAVKKNIDAVQENKKLHSWLKISTLIDNVKVKDKYTVELNLKEAYQPALAELAMPRPYVFVSPKDFKNGTTKDGVKKFDGTGPFKLGEHKKDESADFNKNDQYWGEKSKLNKVQAKVMPAGETAFLSMKKGETNFAFTDDRGTDSLDKDSLKQLKDTGDYQVKRSQPMNTKMLVVNSGKKDNAVSDKTVRQAIGHMVNRDKIAKEILDGQEKPATQLFAKNVTDINFDMPTRKYDLKKAESLLDEAGWKKGKDSDVRQKDGKNLEMAMYYDKGSSSQKEQAEYLQAEFKKMGIKLNINGETSDKIAERRTSGDYDLMFNQTWGLLYDPQSTIAAFKEKNGYESATSGIENKDKIYNSIDDAFKIQNGKERSDAYKNILKQIDDEGIFIPISHGSMTVVAPKDLEKVSFTQSQYELPFNEMQYK

SEQ ID NO: 374 - protein, 532 aa, Staphylococcus aureus; identical to SEQ ID NO: 368

SEQ ID NO: 375 - protein, 302 aa, Staphylococcus aureus
SSDSKDKETTSIKHAMGTTEIKGKPKRVVTLYQGATDVAVSLGVKPVGAVESWTQKPKFEYIKNDLKDTKIVGQEPAPNLEEISKLKPDLIVASKVRNEKVYDQLSKIAPTVSTDTVFKFKDTTKLMGKALGKEKEAEDLLKKYDDKVAAFQKDAKAKYKDAWPLKASVVNFRADHTRIYAGGYAGEILNDLGFKRNKDLQKQVDNGKDIIQLTSKESIPLMNADHIFVVKSDPNAKDAALVKKTESEWTSSKEWKNLDAVKNNQVSDDLDEITWNLAGGYKSSLKLIDDLYEKLNIEKQSK

SEQ ID NO: 376 - protein, 330 aa, Staphylococcus aureus
MNKVIKMLVVTLAFLLVLAGCSGNSNKQSSDNKDKETTSIKHAMGTTEIKGKPKRVVTLYQGATDVAVSLGVKPVGAVESWTQKPKFEYIKNDLKDTKIVGQEPAPNLEEISKLKPDLIVASKVRNEKVYDQLSKIAPTVSTDTVFKFKDTTKLMGKALGKEKEAEDLLKKYDDKVAAFQKDAKAKYKDAWPLKASVVNFRADHTRIYAGGYAGEILNDLGFKRNKDLQKQVDNGKDIIQLTSKESIPLMNADHIFVVKSDPNAKDAALVKKTESEWTSSKEWKNLDAVKNNQVSDDLDEITWNLAGGYKSSLKLIDDLYEKLNIEKQSK

SEQ ID NO: 377 - protein, 330 aa, Staphylococcus aureus; identical to SEQ ID NO: 376

SEQ ID NO: 378 - protein, 330 aa, Staphylococcus aureus
MNKVIKMLVVTLAFLLVLAGCSGNSNKQSSDSKDKETTSIKHAMGTTEIKGKPKRVVTLYQGATDVAVSLGVKPVGAVESWTQKPKFEYIKNDLKDTKIVGQEPAPNLEEISKLKPDLIVASKVRNEKVYDQLSKIAPTVSTDTVFKFKDTTKLMGKALGKEKEAEDLLKKYDDKVAAFQKDAKAKYKDAWPLKASVVNFRADHTRIYAGGYAGEILNDLGFKRNKDLQKQVDNGKDIIQLTSKESIPLMNADHIFVVKSDPNAKDAALVKKTESEWTSSKEWKNLDAVKNNQVSDDLDEITWNLAGGYKSSLKLIDDLYEKLNIEKQSK

SEQ ID NO: 379 - protein, 330 aa, Staphylococcus aureus; identical to SEQ ID NO: 376

SEQ ID NO: 380 - protein, 330 aa, Staphylococcus aureus; identical to SEQ ID NO: 376

SEQ ID NO: 381 - protein, 330 aa, Staphylococcus aureus; identical to SEQ ID NO: 376

SEQ ID NO: 382 - protein, 330 aa, Staphylococcus aureus; identical to SEQ ID NO: 376

SEQ ID NO: 383 - protein, 330 aa, Staphylococcus aureus; identical to SEQ ID NO: 376

SEQ ID NO: 384 - protein, 330 aa, Staphylococcus aureus; identical to SEQ ID NO: 376

SEQ ID NO: 385 - protein, 330 aa, Staphylococcus aureus; identical to SEQ ID NO: 376

SEQ ID NO: 386 - protein, 297 aa, Staphylococcus aureus
KESSTKDTISVKDENGTVKVPKDAKRIVVLEYSFADALAALDVKPVGIADDGKKKRIIKPVREKIGDYTSVGTRKQPNLEEISKLKPDLIIADSSRHKGINKELNKIAPTLSLKSFDGDYKQNINSFKTIAKALNKEKEGEKRLAEHDKLIKKYKDEIKFDRNQKVLPAVVAKAGLLAHPNYSYVGQFLNELGFKNALSDDVTKGLSKYLKGPYLQLDTEHLADLNPERMIIMTDNAKKDSAEFKKLQEDPTWKKLNAVKNNRVDIVDRDVWARSRGLISSEEMAKELVELSKKEQK

SEQ ID NO: 387 - protein, 302 aa, Staphylococcus aureus
MKKLLLPLIIMLLVLAACGNQGEKNNKAETKSYKMDDGKTVDIPKDPKRIAVVAPTYAGGLKKLGANIVAVNQQVDQSKVLKDKFKGVTKIGDGDVEKVAKEKPDLIIVYSTDKDIKKYQKVAPTVVVDYNKHKYLEQQEMLGKIVGKEDKVKAWKKDWEETTAKDGKEIKKAIGQDATVSLFDEFDKKLYTYGDNWGRGGEVLYQAFGLKMQPEQQKLTAKAGWAEVKQEEIEKYAGDYIVSTSEGKPTPGYESTNMWKNLKATKEGHIVKVDAGTYWYNDPYTLDFMRKDLKEKLIKAAK

SEQ ID NO: 388 - protein, 302 aa, Staphylococcus aureus; identical to SEQ ID NO: 387

SEQ ID NO: 389 - protein, 302 aa, Staphylococcus aureus
MKKLLLPLIIMLLVLAACGNQGEKNNKAETKSYKMDDGKTVDIPKDPKRIAVVAPTYAGGLKKLGANIVAVNQQVDQSKVLKDKFKGVTKIGDGDIEKVAKEKPDLIIVYSTDKDIKKYQKVAPTVVVDYNKHKYLEQQEMLGKIVGKEDKVKAWKKDWEETTAKDGKEIKKAIGQDATVSLFDEFDKKLYTYGDNWGRGGEVLYQAFGLKMQPEQQKLTAKAGWAEVKQEEIEKYAGDYIVSTSEGKPTPGYESTNMWKNLKATKEGHIVKVDAGTYWYNDPYTLDFMRKDLKEKLIKAAK

SEQ ID NO: 390 - protein, 302 aa, Staphylococcus aureus; identical to SEQ ID NO: 387

SEQ ID NO: 391 - protein, 302 aa, Staphylococcus aureus; identical to SEQ ID NO: 387

SEQ ID NO: 392 - protein, 302 aa, Staphylococcus aureus; identical to SEQ ID NO: 387

SEQ ID NO: 393 - protein, 302 aa, Staphylococcus aureus; identical to SEQ ID NO: 387

SEQ ID NO: 394 - protein, 302 aa, Staphylococcus aureus; identical to SEQ ID NO: 387

SEQ ID NO: 395 - protein, 302 aa, Staphylococcus aureus; identical to SEQ ID NO: 387

SEQ ID NO: 396 - protein, 302 aa, Staphylococcus aureus; identical to SEQ ID NO: 387

SEQ ID NO: 397 - protein, 293 aa, Staphylococcus aureus
TEEKTEMTTIKDELGTEKIKKNPKRVVVLEYSFADYLAALDMKPVGIADDGSSKNITKSVRDKIGAYESVGSRSQPNMEVISKLKPDLIIADVSRHKKIKSELSKIAPTIMLVSGTGDYNANIEAFKTVAKAVGREKEGEKRLEKHDKILAEIRKKIEQSTLKSAFALGISRAGMFINNEDTFMGQFLIKMGIQPEVTKDKTAHVGERKGGPYIYLNNEELANINPKVMILATDGKTDKNRTKFIDPAVWKSLKAVKDNKVYDVDRNKWLKSRGIIASESMAEDLEKIAEKAK

SEQ ID NO: 398 - protein, 216 aa, Staphylococcus aureus
MEVISKLKPDLIIADVNRHKKIKSELSKIAPTIMLVSGTGDYNANIEAFKTVAKAVGKEKEGEKRLEKHDKILAEIRKKIEQSTLKSAFAFGISRAGMFINNEDTFMGQFLIKMGIQPEVTKDKTMHVGERKGGPYIYLNNEELANINPKVMILATDGKTDKNRTKFIDPAVWKSLKAVKDNKVYDVDRNKWLKSRGIIASESMAEDLEKIAEKAK

SEQ ID NO: 399 - protein, 319 aa, Staphylococcus aureus
MNRNIVKLVVFMLILVVAVAGCGQKDTEEKTEMTTIKDELGTEKIKKNPKRVVVLEYSFADYLAALDMKPVGIADDGSTKNITKSVRDKIGAYESVGSRPQPNMEVISKLKPDLIIADVSRHKKIKSELSKIAPTIMLVSGTGDYNANIEAFKTVAKAVGKEKEGEKRLEKHDKILAEIRKKIEQSTLKSAFAFGISRAGMFINNEDTFMGQFLIKMGIQPEVTKDKTTHVGERKGGPYIYLNNEELANINPKVMILATDGKTDKNRTKFIDPAVWKSLKAVKDNKVYDVDRNKWLKSRGIIASESMAEDLEKIAEKAK

SEQ ID NO: 400 - protein, 319 aa, Staphylococcus aureus
MNRNIVKLVVFMLILVVAVAGCGQKDTEEKTEMTTIKDELGTEKIKKNPKRIVVLEYSFADYLAALDMKPVGIADDGSTKNITKSVRDKIGAYESVGSRPQPNMEVISKLKPDLIIADVSRHKKIKSELSKIAPTIMLVSGTGDYNANIEAFKTVAKAVGKEKEGEKRLEKHNKILAEIRKKIEQSTLKSAFAFGISRAGMFINNEDTFMGQFLIKMGIQPEVTKDKTAHVGERKGGPYIYLNNEELANINPKVMILATNGKTDKNRTKFIDPAVWKSLKAVKDNKVYDVDRNKWLQSRGIMASESMAEDLEKIAEKAK

SEQ ID NO: 401 - protein, 319 aa, Staphylococcus aureus
MNRNIVKLVVFMLILVVAVAGCGQKDTEEKTEMTTIKDELGTEKIKKNPKRVVVLEYSFADYLAALDMKPVGIADDGSSKNITKSVRDKIGAYESVGSRPQPNMEVISKLKPDLIIADVSRHKKIKSELSKIAPTIMLVSGTGDYNANIEAFKTVAKAVGKEKEGEKRLEKHDKILAEIRKKIEQSTLKSAFAFGISRAGMFINNEDTFMGQFLLKMGIQPEVTKDKTTHVGERKGGPYIYLNNEELANINPKVMILATDGKTDKNRTKFIDPAVWKSLKAVKDNKVYDVDRNKWLKSRGIIASESMAEDLEKIAEKAK

SEQ ID NO: 402 - protein, 319 aa, Staphylococcus aureus; identical to SEQ ID NO: 399

SEQ ID NO: 403 - protein, 319 aa, Staphylococcus aureus; identical to SEQ ID NO: 399

SEQ ID NO: 404 - protein, 287 aa, Staphylococcus aureus
MTTIKDELGTEKIKKNPKRVVVLEYSFADYLAALDMKPVGIADDGSTKNITKSVRDKIGAYESVGSRPQPNMEVISKLKPDLIIADVSRHKKIKSELSKIAPTIMLVSGTGDYNANIEAFKTVAKAVGKEKEGEKRLEKHDKILAEIRKKIEQSTLKSAFAFGISRAGMFINNEDTFMGQFLIKMGIQPEVTKDKTTHVGERKGGPYIYLNNEELANINPKVMILATDGKTDKNRTKFIDPAVWKSLKAVKDNKVYDVDRNKWLKSRGIIASESMAEDLEKIAEKAK

SEQ ID NO: 405 - protein, 319 aa, Staphylococcus aureus; identical to SEQ ID NO: 399

SEQ ID NO: 406 - protein, 287 aa, Staphylococcus aureus; identical to SEQ ID NO: 404

SEQ ID NO: 407 - protein, 319 aa, Staphylococcus aureus; identical to SEQ ID NO: 401

SEQ ID NO: 408 - protein, 268 aa, Staphylococcus aureus
GSDDNGSSKSPYHRIVSLMPSNTEILYELGLGKYIVGVSTVDDYPKDVKKGKKQFDALNLNKEELLKAKPDLILAHESQKATANKVLSSLEKQGIKVVYVKDAQSIDETYNTFKQIGKLTHHDKQAEQLVEETKDNIDKVIDSIPAHHKKSKVFIEVSSKPEIYTAGKHTFFNDMLEKLEAQNVYSDINGWNPVTKESIIKKNPDILISTEAKTRSDYMDIIKKRGGFNKINAVKNTRIEVVNGDEVSRPGPRIDEGLKELRDAIYRK

SEQ ID NO: 409 - protein, 295 aa, Staphylococcus aureus
MKKSLIAFILIFMLVLSGCGMKDNDKQGSDDNGSSKSPYHRIVSLMPSNTEILYELGLGKYIVGVSTVDDYPKDVKKGKKQFDALNLNKEELLKAKPDLILAHESQKATANKVLSSLEKQGIKVVYIKDAQSIDETYNTFKQIGKLTHHDKQAEQLVEETKDNIDKVIDSIPAHHKKSKVFIEVSSKPEIYTAGKHTFFNDMLEKLEAQNVYSDINGWNPVTKESIIKKNPDILISTEAKTRSDYMDIIKKRGGFNKINAVKNTRIEVVNGDEVSRPGPRIDEGLKELRDAIYRK

SEQ ID NO: 410 - protein, 295 aa, Staphylococcus aureus
MKKSLIAFILIFMLVLSGCGMKDNDKQGSDDNGSSKSPYHRIVSLMPSNTEILYELGLGKYIVGVSTVDDYPKDVKEGKKQFDALNLNKEELLKAKPDLILAHESQKATANKVLSSLEKQGIKVVYVKDAQSIDETYNTFKQIGKLTHHDKQAEQLVEETKDNIDKVIDSIPAHHKKSKVFIEVSSKPEIYTAGKHTFFNDMLEKLEAQNVYSDINGWNPVTKESIIKKNPDILISTEAKTRSDYMDIIKKRGGFNKINAVKNTRIEVVNGDEVSRPGPRIDEGLKELRDAIYRK

SEQ ID NO: 411 - protein, 295 aa, Staphylococcus aureus
MKKSLIAFILIFMLVLSGCGMKDNDKQGSDDNGSSKSPYHRIVSLMPSNTEILYELGLGKYIVGVSTVDDYPKDVKKGKKQFDALNLNKEELLKAKPDLILAHESQKATANKVLSSLEKQGIKVVYVKDAQSIDETYNTFKQIGKLTHHEKQAEQLVEETKDNIDKVIDSIPAHHKKSKVFIEVSSKPEIYTAGKHTFFNDMLEKLEAQNVYSDINGWNPVTKESIIKKNPDILISTEAKTRSDYMDIIKKRGGFNKINAVKNTRIEVVNGDEVSRPGPRIDEGLKELRDAIYRK

SEQ ID NO: 412 - protein, 295 aa, Staphylococcus aureus
MKKSLIAFILIFMLVLSGCGMKDNDKQGSNDNGSSKSPYHRIVSLMPSNTEILYELGLGKYIVGVSTVDDYPKDVKEGKKQFDALNLNKEELLKEKPDLILAHESQKATANKVLSSLEKQGIKVVYVKDAQSIDETYNTFKQIGKLTHHDKQAEQLVEETKDNIDKVIDSIPAHHKKSKVFIEVSSKPEIYTAGKHTFFNDMLEKLEAQNVYSDINGWNPVTKESIIKKNPDILISTEAKTRSDYMDIIKKRGGFNKINAVKNTRIEVVNGDEVSRPGPRIDEGLKELRDAIYRK

SEQ ID NO: 413 - protein, 295 aa, Staphylococcus aureus
MKKSLIAFILIFMLVLSGCGMKDNDKQGSNDNGSSKSPYHRIVSLMPSNTEILYELGLGKYIVGVSTVDDYPKDVKKGKKQFDALNLNKEELLKAKPDLILAHESQKATANKVLSSLEKQGIKVVYVKDAQSIDETYNTFKQIGKLTHHDKQAEQLVEETKDNIDKVIDSIPAHHKKSKVFIEVSSKPEIYTAGKHTFFNDMLEKLEAQNVYSDINGWNPVTKESIIKKNPDILISTEAKTRSDYMDIIKKRGGFNKINAVKNTRIEVVNGDEVSRPGPRIDEGLKELRDAIYRK

SEQ ID NO: 414 - protein, 295 aa, Staphylococcus aureus; identical to SEQ ID NO: 410

SEQ ID NO: 415 - protein, 275 aa, Staphylococcus aureus
MKDNDKQGSNDNGSSKSPYHRIVSLMPSNTEILYELGLGKYIVGVSTVDDYPKDVKKGKKQFDALNLNKEELLKAKPDLILAHESQKATANKVLSSLEKQGIKVVYVKDAQSIDETYNTFKQIGKLTHHDKQAEQLVEETKDNIDKVIDSIPAHHKKSKVFIEVSSKPEIYTAGKHTFFNDMLEKLEAQNVYSDINGWNPVTKESIIKKNPDILISTEAKTRSDYMDIIKKRGGFNKINAVKNTRIEVVNGDEVSRPGPRIDEGLKELRDAIYRK

SEQ ID NO: 416 - protein, 295 aa, Staphylococcus aureus; identical to SEQ ID NO: 413

SEQ ID NO: 417 - protein, 275 aa, Staphylococcus aureus; identical to SEQ ID NO: 415

SEQ ID NO: 418 - protein, 295 aa, Staphylococcus aureus; identical to SEQ ID NO: 412

SEQ ID NO: 419 - protein, 284 aa, Staphylococcus aureus
SDKSNGKLKVVTTNSILYDMAKNVGGDNVDIHSIVPVGQDPHEYEVKPKDIKKLTDADVILYNGLNLETGNGWFEKALEQAGKSLKDKKVIAVSKDVKPIYLNGEEGNKDKQDPHAWLSLDNGIKYVKTIQQTFIDNDKKHKADYEKQGNKYIAQLEKLNNDSKDKFNDIPKEQRAMITSEGAFKYFSKQYGITPGYIWEINTEKQGTPEQMRQAIEFVKKHKLKHLLVETSVDKKAMESLSEETKKDIFGEVYTDSIGKEGTKGDSYYKMMKSNIETVHGSMK

SEQ ID NO: 420 - protein, 309 aa, Staphylococcus aureus
MKKLVPLLLALLLLVAACGTGGKQSSDKSNGKLKVVTTNSILYDMAKNVGGDNVDIHSIVPVGQDPHEYEVKPKDIKKLTDADVILYNGLNLETGNGWFEKALEQAGKSLKDKKVIAVSKDVKPIYLNGEEGNKDKQDPHAWLSLDNGIKYVKTIQQTFIDNDKKHKADYEKQGNKYIAQLEKLNNDSKDKFNDIPKEQRAMITSEGAFKYFSKQYGITPGYIWEINTEKQGTPEQMRQAIEFVKKHKLKHLLVETSVDKKAMESLSEETKKDIFGEVYTDSIGKEGTKGDSYYKMMKSNIETVHGSMK

SEQ ID NO: 421 - protein, 309 aa, Staphylococcus aureus; identical to SEQ ID NO: 420

SEQ ID NO: 422 - protein, 309 aa, Staphylococcus aureus; identical to SEQ ID NO: 420

SEQ ID NO: 423 - protein, 309 aa, Staphylococcus aureus; identical to SEQ ID NO: 420

SEQ ID NO: 424 - protein, 309 aa, Staphylococcus aureus; identical to SEQ ID NO: 420

SEQ ID NO: 425 - protein, 309 aa, Staphylococcus aureus; identical to SEQ ID NO: 420

SEQ ID NO: 426 - protein, 309 aa, Staphylococcus aureus; identical to SEQ ID NO: 420

SEQ ID NO: 427 - protein, 309 aa, Staphylococcus aureus; identical to SEQ ID NO: 420

SEQ ID NO: 428 - protein, 312 aa, Staphylococcus aureus
MKKLVPLLLALLLLVAACGTGGKQSSDKSNGKLKVVTTNSILYDMAKNVGGDNVDIHSIVPVGQDPHEYEVKPKDIKKLTDADVILYNGLNLETGNGWFEKALEQAGKSLKDKKVIAVSKDVKPIYLNGEEGNKDKQDPHAWLSLDNGIKYVKTIQQTFIDNDKKHKADYEKQGNKYIAQLEKLNNDSKDSKDKFNDIPKEQRAMITSEGAFKYFSKQYGITPGYIWEINTEKQGTPEQMRQAIEFVKKHKLKHLLVETSVDKKAMESLSEETKKDIFGEVYTDSIGKEGTKGDSYYKMMKSNIETVHGSMK

SEQ ID NO: 429 - protein, 309 aa, Staphylococcus aureus; identical to SEQ ID NO: 420

SEQ ID NO: 430 - DNA, 2247 bp, Staphylococcus aureus
ttagaaacaaataaaaatcatgcaacagcttggcaaggatttaaaaatggaagatggaacagacacgtagatgtaagagagtttatccaattaaactacactctttatgaaggtaatgattcatttttagcaggaccaacagaagcaacttctaaactttgggaacaagtaatgcagttatcgaaagaagaacgtgaacgtggcggcatgtgggatatggacacgaaagtagcttcaacaatcacatctcatgatgctggttatttagacaaagatttagaaacaattgtaggtgtacaaactgaaaagccattcaaacgttcaatgcaaccattcggtggtattcgtatggcgaaagcagcttgtgaagcttacggttacgaattagacgaagaaactgaaaaaatctttacagattatcgtaaaacacataaccaaggtgtattcgatgcatattctagagaaatgttgaactgccgtaaagcaggtgtaatcactggtttacctgatgcatacggacgtggacgtattatcggtgactatcgtcgtgtagctttatatggtgtagatttcttaatggaagaaaaaatgcacgacttcaacacgatgtctacagaaatgtcagaagatgtaattcgtttacgtgaagaattatcagaacaatatcgtgcattaaaagaattaaaagaacttgggcaaaaatatggtttcgatttaagccgtccagcagaaaacttcaaagaagcagttcaatggttatacttagcataccttgctgcaattaaagaacaaaacggtgcagcaatgagtttaggtcgtacatcaacatacttagatatctatgctgaacgtgaccttaaagcaggtgttattactgaaagcgaagttcaagaaattattgaccacttcatcatgaaattacgtattgttaaatttgctcgtacacctgattacaatgaattattctctggagacccaacttgggtaactgtatctatcggtggtgtaggtattgacggacgtccacttgttacgaaaaactcattccgtttcttacactcattagataacttaggtccagcaccagaaccaaacttaacagtattatggtcagtacgtttacctgacaacttcaaaacatactgtgcaaaaatgagtattaaaacaagttctatccaatatgaaaatgatgacattatgcgtgaaagctatggcgatgactatggtatcgcatgttgtgtatcagcggtgacaattggtaaacaaatgcaattcttcggtgcacgtgcgaacatagctaaaacattactttacgctatcaatggtggtaaagatgaaaagtctggtgcacaagttggtccaaacttcgaaggtattaacagcgaagtattagaatatgacgaagtattcaagaaatttgatcaaatgatggattggctagcaggtgtttacattaactcattaaatgttattcactacatgcacgataaatacagctatgaacgtattgaaatggcattacatgatacagaaattgtacgtacaatggcaacaggtatcgctggtttatcagtagcagctgactcattatctgcaattaaatatgcacaagttaaaccaattcgtaacgaagaaggtcttgtagtagactttgaaatcgaaggcgacttccctaaatacggtaacaatgacgaccgtgtagatgatatcgcagttgatttagtagaacgctttatgactaaattacgtagtcataaaacatatcgtgattcagaacatacaatgagtgtattaacaattacttcaaacgttgtatacgttaagaaaactggtaacacaccagacggacgtaaagctggcgaaccatttgcaccaggtgcaaacccaatgcatggccgtgaccaaaaaggtgcattatcttcattaagttctgtagctaagatcccttacgattgctgtaaagatggtatttcaaatacattcagtatcgtaccaaaatcattaggtaaagaaccagaagatcaaaaccgtaacttaactagtatgttagatggttacgcaatgcaatgtggtcaccacttaaatattaacgtatttaaccgtgaaacattaatagatgcaatggaacatccagaagaatatccacagttaacaatccgtgtatctggttacgctgttaacttcattaaattaacacgtgaacaacagttagatgtaatttctcgtacattccatgaaagtatgtaa

SEQ ID NO: 431 - DNA, 2250 bp, Staphylococcus aureus
atgttagaaacaaataaaaatcatgcaacagcttggcaaggatttaaaaatggaagatggaacagacacgtagatgtaagagagtttatccaattaaactacactctttatgaaggtaatgattcatttttagcaggaccaacagaagcaacttctaaactttgggaacaagtaatgcagttatcgaaagaagaacgtgaacgtggcggcatgtgggatatggacacgaaagtagcttcaacaatcacatctcatgatgctggttatttagacaaagatttagaaacaattgtaggtgtacaaactgaaaagccattcaaacgttcaatgcaaccattcggtggtattcgtatggcgaaagcagcttgtgaagcttacggttacgaattagacgaagaaactgaaaaaatctttacagattatcgtaaaacacataaccaaggtgtattcgatgcatattctagagaaatgttgaactgccgtaaagcaggtgtaatcactggtttacctgatgcatacggacgtggacgtattatcggtgactatcgtcgtgtagctttatatggtgtagatttcttaatggaagaaaaaatgcacgacttcaacacgatgtctacagaaatgtcagaagatgtaattcgtttacgtgaagaattatcagaacaatatcgtgcattaaaagaattaaaagaacttggacaaaaatatggtttcgatttaagccgtccagcagaaaacttcaaagaagcagttcaatggttatacttagcataccttgctgcaattaaagaacaaaacggtgcagcaatgagtttaggtcgtacatcaacattcttagatatctatgctgaacgtgaccttaaagcaggtgttattactgaaagcgaagttcaagaaattattgaccacttcatcatgaaattacgtattgttaaatttgctcgtacacctgattacaatgaattattctctggagacccaacttgggtaactgaatctatcggtggtgtaggtattgacggacgtccacttgttacgaaaaactcattccgtttcttacactcattagataacttaggtccagcaccagaaccaaacttaacagtattatggtcagtacgtttacctgacaacttcaaaacatactgtgcaaaaatgagtattaaaacaagttctatccaatatgaaaatgatgacattatgcgtgaaagctatggcgatgactatggtatcgcatgttgtgtatcagcgatgacaattggtaaacaaatgcaattcttcggtgcacgtgcgaacttagctaaaacattactttacgctatcaatggtggtaaagatgaaaaatctggcgcacaagttggtccaaacttcgaaggtattaacagcgaagtattagaatatgacgaagtattcaagaaatttgatcaaatgatggattggctagcaggtgtttacattaactcattaaatgttattcactacatgcacgataaatacagctatgaacgtattgaaatggcattacatgatacagaaattgtacgtacaatggcaacaggtatcgctggtttatcagtagcagctgactcattatctgcaattaaatatgcacaagttaaaccaattcgtaacgaagaaggtcttgtagtagactttgaaatcgaaggcgacttccctaaatacggtaacaatgacgaccgtgtagatgatatcgcagttgatttagtagaacgctttatgactaaattacgtagtcataaaacatatcgtgattcagaacatacaatgagtgtattaacaattacttcaaacgttgtatacggtaagaaaactggtaacacaccagacggacgtaaagctggcgaaccatttgcaccaggtgcaaacccaatgcatggccgtgaccaaaaaggtgcattatcttcattaagttctgtagctaagatcccttacgattgctgtaaagatggtatttcaaatacattcagtatcgtaccaaaatcattaggtaaagaaccagaagatcaaaaccgtaacttaactagtatgttagatggttacgcaatgcaatgtggtcaccacttaaatattaacgtatttaaccgtgaaacattaatagatgcaatggaacatccagaagaatatccacagttaacaatccgtgtatctggttacgctgttaacttcattaaattaacacgtgaacaacaattagatgtaatttctcgtacattccatgaaagtatgtaa

SEQ ID NO: 432 - DNA, 2250 bp, Staphylococcus aureus
atgttagaaacaaataaaaatcatgcaacagcttggcaaggatttaaaaatggaagatggaacagacacgtagatgtaagagagtttatccaattaaactacactctttatgaaggtaatgattcatttttagcaggaccaacagaagcaacttctaaactttgggaacaagtaatgcagttatcgaaagaagaacgtgaacgtggcggcatgtgggatatggacacgaaagtagcttcaacaatcacatctcatgatgctggttatttagacaaagatttagaaacaattgtaggtgtacaaactgaaaagccattcaaacgttcaatgcaaccattcggtggtattcgtatggcgaaagcagcttgtgaagcttacggttacgaattagacgaagaaactgaaaaaatctttacagattatcgtaaaacacataaccaaggtgtattcgatgcatattctagagaaatgttgaactgccgtaaagcaggtgtaatcactggtttacctgatgcatacggacgtggacgtattatcggtgactatcgtcgtgtagctttatatggtgtagatttcttaatggaagaaaaaatgcacgacttcaacacgatgtctacagaaatgtcagaagatgtaattcgtttacgtgaagaattatcagaacaatatcgtgcattaaaagaattaaaagaacttggacaaaaatatggtttcgatttaagccgtccagcagaaaacttcaaagaagcagttcaatggttatacttagcataccttgctgcaattaaagaacaaaacggtgcagcaatgagtttaggtcgtacatcaacattcttagatatctatgctgaacgtgaccttaaagcaggcgttattactgaaagcgaagttcaagaaattattgaccacttcatcatgaaattacgtattgttaaatttgctcgtacacctgattacaatgaattattctctggagacccaacttgggtaactgaatctatcggtggtgtaggtattgacggacgtccacttgttacgaaaaactcattccgtttcttacactcattagataacttaggtccagctccagaaccaaacttaacagtattatggtcagtacgtttacctgacaacttcaaaacatactgtgcaaaaatgagtattaaaacaagttctatccaatatgaaaatgatgacattatgcgcgaaagctatggcgatgactatggtatcgcatgttgtgtatcagcgatgacaattggtaaacaaatgcaattcttcggtgcacgtgcgaacttagctaaaacattactttacgcaatcaatggtggtaaagatgaaaaatctggtgcacaagttggtccaaacttcgaaggtattaacagcgaagtattagaatatgacgaagtattcaagaaatttgatcaaatgatggattggctagcaggtgtttacattaactcattaaatgttattcactacatgcacgataaatacagctatgaacgtattgaaatggcattacatgatacagaaattgtacgtacaatggcaacaggtatcgctggtttatcagtagcagctgactcattatctgcaattaaatatgcacaagttaaaccaattcgtaacgaagaaggtcttgtagtagactttgaaatcgaaggcgacttccctaaatacggtaacaatgacgaccgtgtagatgatatcgcagttgatttagtagaacgcttcatgactaaattacgtagtcataaaacatatcgtgattcagaacatacaatgagtgtattaacaattacttcaaacgttgtatacggtaagaaaactggtaacacaccagacggacgtaaagctggcgaaccatttgctccaggtgcaaacccaatgcatggccgtgaccaaaaaggtgcattatcttcattaagttctgtagctaagatcccttacgattgctgtaaagatggtatttcaaatacattcagtatcgtaccaaaatcattaggtaaagaaccagaagatcaaaaccgtaacttaactagtatgttagatggttacgcaatgcaatgtggtcaccacttaaatattaacgtatttaaccgtgaaacattaatagatgcaatggaacatccagaagaatatccacagttaacaatccgtgtatctggttacgctgttaacttcattaaattaacacgtgaacaacaattagatgtaatttctcgtacattccatgaaagtatgtaa

SEQ ID NO: 433 - DNA, 2250 bp, Staphylococcus aureus
atgttagaaacaaataaaaatcatgcaacagcttggcaaggatttaaaaatggaagatggaacagacacgtagatgtaagagagtttatccaattaaactacactctttatgaaggtaatgattcatttttagcaggaccaacagaagcaacttctaaactttgggaacaagtaatgcagttatcgaaagaagaacgtgaacgtggcggcatgtgggatatggacacgaaagtagcttcaacaatcacatctcatgatgctggttatttagacaaagatttagaaacaattgtaggtgtacaaactgaaaagccattcaaacgttcaatgcaaccattcggtggtattcgtatggcgaaagcagcttgtgaagcttacggttacgaattagacgaagaaactgaaaaaatctttacagattatcgtaaaacacataaccaaggtgtattcgatgcatattctagagaaatgttgaactgccgtaaagcaggtgtaatcactggtttacctgatgcatacgggcgtggacgtattatcggtgactatcgtcgtgtagctttatatggtgtagatttcttaatggaagaaaaaatgcacgacttcaacacgatgtctacagaaatgtcagaagatgtaattcgtttacgtgaagaattatcagaacaatatcgtgcattaaaagaattaaaagaacttggacaaaaatatggtttcgatttaagccgtccagcagaaaacttcaaagaagcagttcaatggttatacttagcataccttgctgcaattaaagaacaaaacggtgcagcaatgagtttaggtcgtacatcaacattcttagatatctatgctgaacgtgaccttaaagcaggtgttattactgaaagcgaagttcaagaaattattgaccacttcatcatgaaattacgtattgttaaatttgctcgtacacctgattacaatgaattattctctggagacccaacttgggtaactgaatctatcggtggtgtaggtattgacggacgtccacttgttacgaaaaactcattccgtttcttacactcattagataacttaggtccagcaccagaaccaaacttaacagtattatggtcagtacgtttaccagacaacttcaaaacatactgtgcaaaaatgagtattaaaacaagttctatccaatatgaaaatgatgacattatgcgtgaaagctatggcgatgactatggtatcgcatgttgtgtatcagcgatgacaattggtaaacaaatgcaattcttcggtgcacgtgcgaacttagctaaaacattactttacgctatcaatggtggtaaagatgaaaaatctggtgcacaagttggtccaaacttcgaaggtattaacagcgaagtattagaatatgacgaagtattcaagaaatttgatcaaatgatggattggctagcaggtgtttacattaactcattaaatgttattcactacatgcacgataaatacagctatgaacgtattgaaatggcattacatgatacagaaattgtacgtacaatggcaacaggtatcgctggtttatcagtagcagctgactcattatctgcaattaaatatgcacaagttaaaccaattcgtaacgaagaaggtcttgtagtagactttgaaatcgaaggcgacttccctaaatacggtaacaatgacgaccgtgtagatgatatcgcagttgatttagtagaacgctttatgactaaattacgtagtcataaaacatatcgtgattcagaacatacaatgagtgtattaacaattacttcaaacgttgtatacggtaagaaaactggtaacacaccagacggacgtaaagctggcgaaccatttgcaccaggtgcaaacccaatgcatggccgtgaccaaaaaggtgcattatcttcattaagttctgtagctaagattccttacgattgctgtaaagatggtatttcaaatacattcagtatcgtaccaaaatcattaggtaaagaaccagaagatcaaaaccgtaacttaactagtatgttagatggttacgcaatgcaatgtggtcaccacttaaatattaacgtatttaaccgtgaaacattaatagatgcaatggaacatccagaagaatatccacagttaacaatccgtgtatctggttacgctgttaacttcattaaattaacacgtgaacaacaattagatgtaatttctcgtacattccatgaaagtatgtaa

SEQ ID NO: 434 - DNA, 2250 bp, Staphylococcus aureus
atgttagaaacaaataaaaatcatgcaacagcttggcaaggatttaaaaatggaagatggaacagacacgtagatgtaagagagtttatccaattaaactacactctttatgaaggtaatgattcatttttagcaggaccaacagaagcaacttctaaactttgggaacaagtaatgcagttatcgaaagaagaacgtgaacgtggcggcatgtgggatatggacacgaaagtagcttcaacaatcacatctcatgatgctggttatttagacaaagatttagaaacaattgtaggtgtacaaactgaaaagccattcaaacgttcaatgcaaccattcggtggtattcgtatggcgaaagcagcttgtgaagcttacggttacgaattagacgaagaaactgaaaaaatctttacagattatcgtaaaacacataaccaaggtgtattcgatgcatattctagagaaatgttgaactgccgtaaagcaggtgtaatcactggtttacctgatgcatacggacgtggacgtattatcggtgactatcgtcgtgtagctttatatggtgtagatttcttaatggaagaaaaaatgcacgacttcaacacgatgtctacagaaatgtcagaagatgtaattcgtttacgtgaagaattatcagaacaatatcgtgcattaaaagaattaaaagaacttggacaaaaatatggtttcgatttaagccgtccagcagaaaacttcaaagaagcagttcaatggttatacttagcataccttgctgcaattaaagaacaaaacggtgcagcaatgagtttaggtcgtacatcaacattcttagatatctatgctgaacgtgaccttaaagcaggcgttattactgaaagcgaagttcaagaaattattgaccacttcatcatgaaattacgtattgttaaatttgctcgtacacctgattacaatgaattattctctggagacccaacttgggtaactgaatctatcggtggtgtaggtattgacggacgtccacttgttacgaaaaactcattccgtttcttacactcattagataacttaggtccagctccagaaccaaacttaacagtattatggtcagtacgtttacctgacaacttcaaaacatactgtgcaaaaatgagtattaaaacaagttctatccaatatgaaaatgatgacattatgcgtgaaagctatggcgatgactatggtatcgcatgttgtgtatcagcgatgacaattggtaaacaaatgcaattcttcggtgcacgtgcgaacttagctaaaacattactttacgctatcaatggtggtaaagatgaaaaatctggtgcacaagttggtccaaacttcgaaggtattaacagcgaagtattagaatatgacgaagtattcaagaaatttgatcaaatgatggattggctagcaggtgtttacattaactcattaaatgttattcactacatgcacgataaatacagctatgaacgtattgaaatggcattacatgatacagaaattgtacgtacaatggcaacaggtatcgctggtttatcagtagcagctgactcattatctgcaattaaatatgcacaagttaaaccaattcgtaacgaagaaggtcttgtagtagactttgaaatcgaaggcgacttccctaaatacggtaacaatgacgaccgtgtagatgatatcgcagttgatttagtagaacgctttatgactaaattacgtagtcataaaacatatcgtgattcagaacatacaatgagtgtattaacaattacttcaaacgttgtatacggtaagaaaactggtaacacaccagacggacgtaaagctggcgaaccatttgcaccaggtgcaaacccaatgcatggccgtgaccaaaaaggtgcattatcttcattaagttctgtagctaagatcccttacgattgctgtaaagatggtatttcaaatacattcagtatcgtaccaaaatcattaggtaaagaaccagaagatcaaaaccgtaacttaactagtatgttagatggttacgcaatgcaatgtggtcaccacttaaatattaacgtatttaaccgtgaaacattaatagatgcaatggaacatccagaagaatatccacagttaacaatccgtgtatctggttacgctgttaacttcattaaattaacacgtgaacaacaattagatgtaatttctcgtacattccatgaaagtatgtaa

SEQ ID NO: 435 - DNA, 2250 bp, Staphylococcus aureus
atgttagaaacaaataaaaatcatgcaacagcttggcaaggatttaaaaatggaagatggaacagacacgtagatgtaagagagtttatccaattaaactacactctttatgaaggtaatgattcatttttagcaggaccaacagaagcaacttctaaactttgggaacaagtaatgcagttatcgaaagaagaacgtgaacgtggcggcatgtgggatatggacacgaaagtagcttcaacaatcacatctcatgatgctggttatttagacaaagatttagaaacaattgtaggtgtacaaactgaaaagccattcaaacgttcaatgcaaccattcggtggtattcgtatggcgaaagcagcttgtgaagcttacggttacgaattagacgaagaaactgaaaaaatctttacagattatcgtaaaacacataaccaaggtgtattcgatgcatattctagagaaatgttgaactgccgtaaagcaggtgtaatcactggtttacctgatgcatacggacgtggacgtattatcggtgactatcgtcgtgtagctttatatggtgtagatttcttaatggaagaaaaaatgcacgacttcaacacgatgtctacagaaatgtcagaagatgtaattcgtttacgtgaagaattatcagaacaatatcgtgcattaaaagaattaaaagaacttggacaaaaatatggtttcgatttaagccgtccagcagaaaacttcaaagaagcagttcaatggttatacttagcataccttgctgcaattaaagaacaaaacggtgcagcaatgagtttaggtcgtacatcaacattcttagatatctatgctgaacgtgaccttaaagcaggcgttattactgaaagcgaagttcaagaaattattgaccacttcatcatgaaattacgtattgttaaatttgctcgtacacctgattacaatgaattattctctggagacccaacttgggtaactgaatctatcggtggtgtaggtattgacggacgtccacttgttacgaaaaactcattccgtttcttacactcattagataacttaggtccagctccagaaccaaacttaacagtattatggtcagtacgtttacctgacaacttcaaaacatactgtgcaaaaatgagtattaaaacaagttctatccaatatgaaaatgatgacattatgcgtgaaagctatggcgatgactatggtatcgcatgttgtgtatcagcgatgacaattggtaaacaaatgcaattcttcggtgcacgtgcgaacttagctaaaacattactttacgctatcaatggtggtaaagatgaaaaatctggtgcacaagttggtccaaacttcgaaggtattaacagcgaagtattagaatatgacgaagtattcaagaaatttgatcaaatgatggattggctagcaggtgtttacattaactcattaaatgttattcactacatgcacgataaatacagctatgaacgtattgaaatggcattacatgatacagaaattgtacgtacaatggcaacaggtatcgctggtttatcagtagcagctgactcattatctgcaattaaatatgcacaagttaaaccaattcgtaacgaagaaggtcttgtagtagactttgaaatcgaaggcgacttccctaaatacggtaacaatgacgaccgtgtagatgatattgcagttgatttagtagaacgcttcatgactaaattacgtagtcataaaacatatcgtgattcagaacatacaatgagtgtattaacaattacttcaaacgttgtatacggtaagaaaactggtaacacaccagacggacgtaaagctggcgaaccatttgctccaggtgcaaacccaatgcatggccgtgaccaaaaaggtgcattatcttcattaagttctgtagctaagatcccttacgattgctgtaaagatggtatttcaaatacattcagtatcgtaccaaaatcattaggtaaagaaccagaagatcaaaaccgtaacttaactagtatgttagatggttacgcaatgcaatgtggtcaccacttaaatattaacgtatttaaccgtgaaacattaatagatgcaatggaacatccagaagaatatccacagttaacaatccgtgtatctggttacgctgttaacttcattaaattaacacgtgaacaacaattagatgtaatttctcgtacattccatgaaagtatgtaa

SEQ ID NO: 436 - DNA, 2250 bp, Staphylococcus aureus; identical to SEQ ID NO: 432

SEQ ID NO: 437 - DNA, 2250 bp, Staphylococcus aureus; identical to SEQ ID NO: 435

SEQ ID NO: 438 - DNA, 2250 bp, Staphylococcus aureus; identical to SEQ ID NO: 435

SEQ ID NO: 439 - DNA, 2250 bp, Staphylococcus aureus; identical to SEQ ID NO: 435

SEQ ID NO: 440 - DNA, 2250 bp, Staphylococcus aureus; identical to SEQ ID NO: 434

SEQ ID NO: 441 - DNA, 1511 bp, Staphylococcus aureus
aaaaaagaaaacaagcaattaacgtatacgacggttaaagatatcggggatatgaacccgcatgtttacggtggatcgatgtctgctgaaagtatgatatacgagccgcttgtacgtaacacgaaagacgggattaagcctttactagctaaaaaatggggtgtgtctgaagatgggaagacatacacgttccatttgagagatgacgttaaattccatgatggtacgccatttgatgctgacgcagttaagaaaaatattgacgcagttcaagaaaacaaaaaattgcattcttggttaaagatttcaacattaattgacaatgttaaagttaaagataagtacacggttgaattgaatttgaaagaagcatatcaacctgcattggctgaattagcgatgcctcgtccatatgtatttgtgtctccaaaagactttaaaaacggcacaacaaaagatggcgttaaaaagttcgatggtactggtccgtttaaattaggtgaacacaaaaaagatgagtctgcagactttaacaaaaatgatcaatactggggcgaaaagtctaaacttaacaaagtacaagcaaaagtaatgcctgctggtgaaacagcattcctatcaatgaaaaaaggtgaaacgaactttgccttcacagatgatggaggtacagatagcttagacaaagactctttaaaacaattgaaagatactggtgactatcaagttaagcgtagtcaacctatgaatacgaaaatgttagttgtcaattctggtaaaaaagataacgctgtcagtgacaaaacagtcagacaagcgattggtcatatggtaaacagagataaaattgccaaagaaattttagatggtcaagaaaaaccagcaactcaattatttgcgaaaaatgtaacagacattaatttcgatatgccaacacgtaagtatgaccttaaaaaagcagaatcattattagatgaagctggttggaagaaaggtaaagacagcgatgttcgtcaaaaagatggtaaaaaccttgaaatggcaatgtactatgacaaaggttcttcaagtcaaaaagaacaagcagaatacttacaagcagaatttaagaaaatgggtattaagttaaacatcaatggcgaaacatcagataaaattgctgaacgtcgtacttctggtgattatgacttaatgttcaaccaaacttggggattattgtacgatccacaaagtactattgcagcatttaaagcgaaaaatggtatgaaagtgcaacatcaggcattgagaataaagataaaatatacaacagcattgatgacgcatttaaaatccaaaacggtaaagagcgttcagacgcttataaaaacattttgaaacaagttgatgatgaaggtatctttatccctgtttcacacggtagtatgacagttgttgcgccgaaagatttagaaaaagtatcattcacacaatcacagtacgaattaccattcaatgaaatgcagtataaataa

SEQ ID NO: 442 - DNA, 1599 bp, Staphylococcus aureus
atgagaaaactaactaaaatgagtgcaatgttacttgcatcagggctaattttaactggttgtggcggtaataaaggtttagaggagaaaaaagaaaacaagcaattaacgtatacgacggttaaagatatcggggatatgaacccgcatgtttacggtggatcgatgtctgctgaaagtatgatatacgagccacttgtacgtaacacgaaagatgggattaagcctttattagctaaaaaatgggatgtttctgaagatgggaagacatatacattccatttgagagatgacgttaaattccatgatggtacgccatttgatgctgacgcagttaagaaaaatattgacgcggttcaagaaaacaaaaaattgcattcttggttaaagatttcaacattaattgacaatgttaaagttaaagataagtacacggttgaattgaatttgaaagaagcatatcaacctgcattggctgaattagcgatgcctcgtccatatgtatttgtgtctccaaaagactttaaaaacggcacaacaaaagatggcgttaaaaagttcgatggtactggtccatttaaattaggtgaacacaaaaaagatgagtctgcagactttaacaaaaatgatcaatactggggcgaaaagtctaaacttaacaaagtacaagcaaaagtaatgcctgctggtgaaacagcattcctatcaatgaaaaaaggtgaaacgaactttgccttcacagatgatagaggtacagatagcttagacaaagactctttaaaacaattgaaagatacaggtgactatcaagttaagcgtagtcaacctatgaatacgaaaatgttagttgtcaattctggtaaaaaagatagcgctgtcagtgacaaaacagtcagacaagcgattggtcatatggtaaacagagataaaattgccaaagaaattttagatggtcaagaaaaaccagcaactcaattatttgcgaaaaatgtaacagacattaatttcgatatgccaacacgtaagtatgaccttaaaaaagcagaatcattattagatgaagctggttggaagaaaggtaaagacagcgatgttcgtcaaaaagatggtaaaaaccttgaaatggcaatgtactatgacaaaggttcttcaagtcaaaaagaacaagcagaatacttacaagcagaatttaagaaaatgggtattaagttaaacatcaatggcgaaacatcagataaaattgctgaacgtcgtacttctggtgattatgacttaatgttcaaccaaacttggggattattgtacgatccacaaagtactattgcagcatttaaagcgaaaaatggttatgaaagtgcaacatcaggcattgagaataaagataaaatatacaacagcattgatgacgcatttaaaatccaaaacggtaaagagcgttcagacgcttataaaaacattttgaaacaagttaatgatgaaggtatctttatccctatttcacacggtagtatgacagttgttgcgccgaaagatttagaaaaagtatcattcacacaatcacagtatgaattaccattcaatgaaatgcagtataaataa

SEQ ID NO: 443 - DNA, 1599 bp, Staphylococcus aureus
atgagaaaactaactaaaatgagtgcaatgttacttgcatcagggctaattttaactggttgtggcggtaataaaggtttagaggagaaaaaagaaaacaagcaattaacgtatacgacggttaaagatatcggtgatatgaatccgcatgtttacggtggatcaatgtctgctgaaagtatgatatacgagccgcttgtacgtaacacgaaagatggtattaagcctttactagctaaaaaatgggatgtgtctgaagatgggaagacttatacattccatttaagagatgatgtgaaattccatgatggaacaacatttgatgctgacgcagttaagaaaaatattgatgcggttcaacaaaataaaaaattgcattcttggttaaagatttcaacattaattgacaatgttaaagttaaagataagtacacggttgaattgaatttgaaagaagcatatcaacctgcattggctgaattagcgatgcctcgtccatatgtatttgtgtctccaaaagactttaaaaacggtacaacaaaagatggcgttaaaaagttcgatggtactggtccatttaaattaggtgaacacaaaaaagatgagtctgcagactttaacaaaaatgatcaatactggggcgaaaagtctaaacttaacaaagtacaagcaaaagtaatgcctgctggtgaaacagcattcctatcaatgaaaaaaggtgaaacgaactttgccttcacagatgatagaggtacggatagcttagacaaagactctttaaaacaattgaaagatacaggtgactatcaagttaagcgtagtcaacctatgaatacgaaaatgttagttgtcaattctggtaaaaaagataacgctgtcagtgacaaaacagtcagacaagcgattggtcatatggtaaacagagataaaattgccaaagaaattttagatggtcaagaaaaaccagcaactcaattatttgcgaaaaatgtaacagacattaatttcgatatgccaacacgtaagtatgaccttaaaaaagcagaatcattattagatgaagctggttggaagaaaggtaaagacagtgatgttcgtcaaaaagatggtaaaaaccttgaaatggcaatgtactatgacaaaggttcttcaagtcaaaaagaacaagcagaatacttacaagcagaatttaagaaaatgggtattaagttaaacatcaatggcgaaacatcagataaaattgctgaacgtcgtacttctggtgattatgacttaatgttcaaccaaacttggggattattgtacgatccacaaagtactattgcagcatttaaagcgaaaaatggttatgaaagtgcaacatcaggcattgagaacaaagataaaatatacaacagcattgatgacgcatttaaaatccaaaacggtaaagagcgttcagacgcttataaaaacattttgaaacaaattgatgatgaaggtatctttatccctatttcacacggtagtatgacagttgttgcgccgaaagatttagaaaaagtatcattcacacaatcacagtatgaattaccattcaatgaaatgcagtataaataa

SEQ ID NO: 444 - DNA, 1599 bp, Staphylococcus aureus
atgagaaaactaactaaaatgagtgcaatgttacttgcatcagggctaattttaactggttgtggcggtaataaaggtttagaggagaaaaaagaaaacaagcaattaacgtatacgacggttaaagatatcggggatatgaatccgcatgtttacggtggatcgatgtctgctgaaagtatgatatacgagccgcttgtacgtaacacgaaagatgggattaagcctttactagctaaaaaatgggatgtgtcagaagatgggaagacatacacgttccatttgagagatgacgttaaattccatgatggtacgccatttgatgctgacgcagttaagaaaaatattgacgcagttcaagaaaacaaaaaattgcattcttggttaaagatttcaacattaattgacaatgttaaagttaaagataagtacacggttgaattaaatttgaaagaagcatatcaacctgcattggctgaattagcgatgcctcgtccatatgtatttgtatctccaaaagactttaaaaacggcacaacaaaagatggcgttaaaaagttcgatggtactggtccatttaaattaggtgaacacaaaaaagatgagtctgcagactttaataaaaatgatcaatactggggcgaaaagtctaaacttaacaaagtacaagcaaaagtaatgcctgctggtgaaacagcattcctatcaatgaaaaaaggtgaaacaaactttgccttcacagacgatagaggtacagatagcttagacaaagactctttaaaacaattgaaagatacaggtgactatcaagttaagcgtagtcaacctatgaatacgaaaatgttagtggtcaattctggtaaaaaagataacgctgtcagtgacaaaacagtcagacaagcgattggtcatatggtaaacagagataaaattgccaaagaaattttagatggtcaagaaaaaccagcaactcaattatttgcgaaaaatgtaacagacattaatttcgatatgccaacacgtaagtatgaccttaaaaaagcagaatcattattagatgaagctggttggaagaaaggtaaagacagcgatgttcgtcaaaaagatggtaaaaaccttgaaatggcaatgtactatgacaaaggttcttcaagtcaaaaagaacaagcagaatacttacaagcagaatttaagaaaatgggtattaagttaaacatcaatggcgaaacatcagataaaattgctgaacgtcgtacttctggtgattatgacttaatgttcaaccaaacttggggattattgtacgatccacaaagtactattgcagcatttaaagcgaaaaatggttatgaaagtgcaacatcaggcattgagaacaaagataaaatatacaacagcattgatgacgcatttaaaatccaaaacggtaaagagcgttcagacgcttataaaaacattttgaaacaaattgatgatgaaggtatttttatccctatttcacacggtagtatgacagttgttgcgccgaaagatttagaaaaagtagcattcacacaatcacagtatgaattaccattcaatgaaatgcagtataaataa

SEQ ID NO: 445 - DNA, 1599 bp, Staphylococcus aureus
atgagaaaactaactaaaatgagtgcaatgttacttgcatcagggctaattttaactggttgtggcggtaataaaggtttagaggagaaaaaagaaaacaagcaattaacgtatacgacggttaaagatatcggtgatatgaatccgcatgtttacggtggatcgatgtctgctgaaagtatgatatacgagccgcttgtacgtaacacgaaagatggaattaagcctttactagctaaaaaatgggatgtgtctgaagatgggaagacatatacattccatttgagagatgacgttaaattccatgatggtacaccatttgatgctgacgcagttaagaaaaatattgatgcggttcaacaaaataaaaaattgcattcttggttaaagatttcaacattaattgacaatgttaaagttaaagataagtacacggttgaattgaatttgaaagaagcatatcaacctgcattggctgaattagcgatgcctcgtccatatgtatttgtgtctccaaaagactttaaaaacggtacaacaaaagatggcgttaaaaagttcgatggtactggtccatttaaattaggtgaacataaaaaagatgagtctgcagactttaacaaaaatgatcaatactggggcgaaaagtctaaacttaacaaagtacaagcaaaagtaatgcctgctggtgaaacagcattcctatcaatgaaaaaaggtgaaacgaactttgccttcacagatgatagaggtacggatagcttagacaaagactctttaaaacaattgaaagatacaggtgactatcaagttaagcgtagtcaacctatgaatacgaaaatgttagttgtcaattctggtaaaaaagataacgctgtgagtgacaaaacagtcagacaagcgattggtcatatggtaaacagagataaaattgccaaagaaattttagatggtcaagaaaaaccagcaactcaattatttgcgaaaaatgtaacagatattaatttcgatatgccaacacgtaagtatgaccttaaaaaagcagaatcattattagatgaagctggttggaagaaaggtaaagacagcgatgttcgtcaaaaagatggtaaaaaccttgaaatggcaatgtactatgacaaaggttcttcaagtcaaaaagaacaagcagaatacttacaagcagaatttaagaaaatgggtattaagttaaacatcaatggcgaaacatcagataaaattgctgaacgtcgtacttctggtgattatgacttaatgttcaaccaaacttggggattattgtacgatccacaaagtactattgcagcatttaaagcgaaaaatggttatgaaagtgcaacatcaggcattgagaacaaagataaaatatacaacagcattgatgacgcatttaaaatccaaaacggtaaagagcgttcaggcgcttataaaaacattttgaaacaaattgatgatgaaggtatctttatccctatttcacacggtagtatgacagttgttgcgccgaaagatttagaaaaagtatcattcacacaatcacagtatgaattaccattcaatgaaatgcagtataaataa

SEQ ID NO: 446 - DNA, 1599 bp, Staphylococcus aureus
atgagaaaactaactaaaatgagtgcaatgttacttgcatcagggctaattttaactggttgtggcggtaataaaggtttagaggagaaaaaagaaaacaagcaattaacgtatacgacggttaaagatatcggtgatatgaatccgcatgtttacggtggatcaatgtctgctgaaagtatgatatacgagccgcttgtacgtaacacgaaagatggtattaagcctttactagctaaaaagtgggatgtgtctgaagatgggaagacatacacgttccatttgagagatgacgttaaattccatgatggtacgccatttgatgctgacgcagttaagaaaaatattgacgcagttcaagaaaacaaaaaattgcattcttggttaaagatttcgacattaattgacaatgttaaagttaaagataagtacacggttgaattgaatttgaaagaagcatatcaacctgcattggctgaattagcgatgcctcgtccatatgtatttgtgtctccaaaagactttaaaaacggtacaacaaaagatggcgttaaaaagttcgatggtactggtccatttaaattaggtgaacacaaaaaagatgagtctgcagactttaacaaaaatgatcaatactggggcgaaaagtctaaacttaacaaagtacaagcaaaagtaatgcctgctggtgaaacagcattcctatcaatgaaaaaaggtgaaacgaactttgccttcacagatgatagaggtacagatagcttagacaaagactctttaaaacaattgaaagatacaggtgactatcaagttaagcgtagtcaacctatgaatacgaaaatgttagttgtcaattctggtaaaaaagataacgctgtgagtgacaaaacagtcagacaagcgattggtcatatggtaaacagagataaaattgccaaagaaattttagatggtcaagaaaaaccagcaactcaattatttgcgaaaaatgtaacagacattaatttcgatatgccaacacgtaagtatgaccttaaaaaagcagaatcattattagatgaagctggttggaagaaaggtaaagacagcgatgttcgtcaaaaagatggtaaaaaccttgaaatggcaatgtactatgacaaaggttcttcaagtcaaaaagaacaagcagaatacttacaagcagaatttaagaaaatgggtattaagttaaacatcaatggcgaaacatcagataaaattgctgaacgtcgtacttctggtgattatgacttaatgttcaaccaaacttggggattattgtacgatccacaaagtactattgcagcatttaaagcgaaaaatggttatgaaagtgcaacatcaggcattgagaacaaagataaaatatacaacagcattgatgacgcatttaaaatccaaaacggtaaagagcgttcagacgcttataaaaacattttgaaacaaattgatgatgaaggtatctttatccctatttcacacggtagtatgacagttgttgcaccaaaagatttagaaaaagtatcattcacacaatcacagtatgaattaccattcaatgaaatgcagtataaataa

SEQ ID NO: 447 - DNA, 1599 bp, Staphylococcus aureus; identical to SEQ ID NO: 443

SEQ ID NO: 448 - DNA, 1599 bp, Staphylococcus aureus; identical to SEQ ID NO: 446

SEQ ID NO: 449 - DNA, 1599 bp, Staphylococcus aureus
atgagaaaactaactaaaatgagtgcaatgttacttacatcagggctaattttaactggttgtggcggtaataaaggtttagaggagaaaaaagaaaacaagcaattaacgtatacgacggttaaagatatcggtgatatgaatccgcatgtttacggtggatcaatgtctgctgaaagtatgatatacgagccgcttgtacgtaacacgaaagatggtattaagcctttactagctaaaaagtgggatgtgtctgaagatgggaagacatacacgttccatttgagagatgacgttaaattccatgatggtacgccatttgatgctgacgcagttaagaaaaatattgacgcagttcaagaaaacaaaaaattgcattcttggttaaagatttcgacattaattgacaatgttaaagttaaagataagtacacggttgaattgaatttgaaagaagcatatcaacctgcattggctgaattagcgatgcctcgtccatatgtatttgtgtctccaaaagactttaaaaacggtacaacaaaagatggcgttaaaaagttcgatggtactggtccatttaaattaggtgaacacaaaaaagatgagtctgcagactttaacaaaaatgatcaatactggggcgaaaagtctaaacttaacaaagtacaagcaaaagtaatgcctgctggtgaaacagcattcctatcaatgaaaaaaggtgaaacgaactttgccttcacagatgatagaggtacagatagcttagacaaagactctttaaaacaattgaaagatacaggtgactatcaagttaagcgtagtcaacctatgaatacgaaaatgttagttgtcaattctggtaaaaaagataacgctgtgagtgacaaaacagtcagacaagcgattggtcatatggtaaacagagataaaattgccaaagaaattttagatggtcaagaaaaaccagcaactcaattatttgcgaaaaatgtaacagacattaatttcgatatgccaacacgtaagtatgaccttaaaaaagcagaatcattattagatgaagctggttggaagaaaggtaaagacagcgatgttcgtcaaaaagatggtaaaaaccttgaaatggcaatgtactatgacaaaggttcttcaagtcaaaaagaacaagcagaatacttacaagcagaatttaagaaaatgggtattaagttaaacatcaatggcgaaacatcagataaaattgctgaacgtcgtacttctggtgattatgacttaatgttcaaccaaacttggggattattgtacgatccacaaagtactattgcagcatttaaagcgaaaaatggttatgaaagtgcaacatcaggcattgagaacaaagataaaatatacaacagcattgatgacgcatttaaaatccaaaacggtaaagagcgttcagacgcttataaaaacattttgaaacaaattgatgatgaaggtatctttatccctatttcacacggtagtatgacagttgttgcaccaaaagatttagaaaaagtatcattcacacaatcacagtatgaattaccattcaatgaaatgcagtataaataa

SEQ ID NO: 450 - DNA, 1599 bp, Staphylococcus aureus
atgagaaaactaactaaaatgagtgcaatgttacttgcatcagggctaattttaactggttgtggcggtaataaaggtttagaggagaaaaaagaaaacaagcaattaacgtatacgacggttaaagatatcggtgatatgaatccgcatgtttacggtggatcaatgtctgctgaaagtatgatatacgagccgcttgtacgtaacacgaaagatggtattaagcctttactagctaaaaagtgggatgtgtctgaagatgggaagacatacacgttccatttgagagatgacgttaaattccatgatggtacgccatttgatgctgacgcagttaagaaaaatattgacgcagttcaagaaaacaaaaaattgcattcttggttaaagatttcgacattaattgacaatgttaaagttaaagataagtacacggttgaattgaatttgaaagaagcatatcaacctgcattggctgaattagcgatgcctcgtccatatgtatttgtgtctccaaaagactttaaaaacggtacaacaaaagatggcgttaaaaagttcgatggtactggtccatttaaattaggtgaacacaaaaaagatgagtctgcagactttaacaaaaatgatcaatactggggcgaaaagtctaaacttaacaaagtacaagcaaaagtaatgcctgctggtgaaacagcattcctatcaatgaaaaaaggtgaaacgaactttgccttcacagatgatagaggtacagatagcttagacaaagactctttaaaacaattgaaagatacaggtgactatcaagttaagcgtagtcaacctatgaatacgaaaatgttagttgtcaattctggtaaaaaagataacgctgtgagtgacaaaacagtcagacaagcgattggtcatatggtaaacagagataaaattgccaaagaaattttagatggtcaagaaaaaccagcaactcaattatttgcgaaaaatgtaacagacattaatttcgatatgccaacacgtaagtatgaccttaaaaaagcagaatcattattagatgaagctggttggaagaaaggtaaagacagcgatgttcgtcaaaaagatggtaaaaaccttgaaatggcaatgtactatgacaaaggttcttcaagtcaaaaagaacaagcagaatacttacaagcagaatttaagaaaatgggtattaagttaaacatcaatggcgaaacatcagataaaattgctgaacgtcgtacttctggtgattatgacttaatgttcaaccaaacttggggattattgtacgatccacaaagtactattgcagcatttaaagagaaaaatggttatgaaagtgcaacatcaggcattgagaacaaagataaaatatacaacagcattgatgacgcatttaaaatccaaaacggtaaagagcgttcagacgcttataaaaacattttgaaacaaattgatgatgaaggtatctttatccctatttcacacggtagtatgacagttgttgcaccaaaagatttagaaaaagtatcattcacacaatcacagtatgaattaccattcaatgaaatgcagtataaataa

SEQ ID NO: 451 - DNA, 1599 bp, Staphylococcus aureus; identical to SEQ ID NO: 445

SEQ ID NO: 452 - DNA, 909 bp, Staphylococcus aureus
tcatctgatagcaaagataaggaaacaacttcaattaaacatgcaatgggtacaactgaaattaaagggaaaccaaagcgtgttgttacgctatatcaaggtgccactgacgtcgctgtatctttaggtgttaaacctgtaggtgctgtagaatcatggacacaaaaaccgaaattcgaatacataaaaaatgatttaaaagatactaagattgtaggtcaagaacctgcacctaacttagaggaaatctctaaattaaaaccggacttaattgtcgcgtcaaaagttagaaatgaaaaagtttacgatcaattatctaaaatcgcaccaacagtttctactgatacagttttcaaattcaaagatacaactaagttaatggggaaagctttagggaaagaaaaagaagctgaagatttacttaaaaagtacgatgataaagtagctgcattccaaaaagatgcaaaagcaaagtataaagatgcatggccattgaaagcttcagttgttaacttccgtgctgatcatacaagaatttatgctggtggatatgctggtgaaatcttaaatgatttaggattcaaacgtaataaagacttacaaaaacaagttgataatggtaaagatattatccaacttacatctaaagaaagtattccattaatgaacgctgatcatatttttgtagtaaaatcagatccaaatgcgaaagatgctgcattagttaaaaagactgaaagcgaatggacttcaagtaaagagtggaaaaatttagacgcagttaaaaacaaccaagtatctgatgatttagatgaaatcacttggaacttagctggcggatataaatcatcattaaaacttattgacgatttatatgaaaagttaaatattgaaaaacaatcaaaataa

SEQ ID NO: 453 - DNA, 993 bp, Staphylococcus aureus
atgaataaagtaattaaaatgcttgttgttacgcttgctttcctacttgttttagcaggatgtagtgggaattcaaataaacaatcatctgataacaaagataaggaaacaacttcaattaaacatgcaatgggtacaactgaaattaaagggaaaccaaagcgtgttgttacgctatatcaaggtgccactgacgtcgctgtatctttaggtgttaaacctgtaggtgctgtagaatcatggacacaaaaaccgaaattcgaatacataaaaaatgatttaaaagatactaagattgtaggtcaagaacctgcgcctaacttagaggaaatctctaaattaaaaccggacttaattgtcgcgtcaaaagttagaaatgaaaaagtttacgatcaattatctaaaatcgcaccaacagtttctactgatacagttttcaaattcaaagatacaactaagttaatggggaaagctttagggaaagaaaaagaagctgaagatttacttaaaaagtacgatgataaagtagctgcattccaaaaagatgcaaaagcaaagtataaagatgcatggccattgaaagcttcagttgttaacttccgtgctgatcatacaagaatttatgctggtggatatgctggtgaaatcttaaatgatttaggattcaaacgtaataaagacttacaaaaacaagttgataatggtaaagatattatccaacttacatctaaagaaagcattccattaatgaacgctgatcatatttttgtagtaaaatcagatccaaatgcgaaagatgctgcattagttaaaaagactgaaagcgaatggacttcaagtaaagagtggaaaaatttagacgcagttaaaaacaaccaagtatctgatgatttagatgaaatcacttggaacttagctggcggatataaatcatcattaaaacttattgacgatttatatgaaaagttaaatattgaaaaacaatcaaaataa

SEQ ID NO: 454 - DNA, 993 bp, Staphylococcus aureus
atgaataaagtaattaaaatgcttgttgttacgcttgctttcctacttgttttagcaggatgtagtgggaattcaaataaacaatcatctgataacaaagataaggaaacaacttcaattaaacatgcaatgggtacaactgaaattaaagggaaaccaaagcgtgttgttacgctatatcaaggtgccactgacgtcgctgtatctttaggtgttaaacctgtaggtgctgtagaatcatggacacaaaaaccgaaattcgaatacataaaaaatgatttaaaagatactaagattgtaggtcaagaacctgcacctaacttagaggaaatctctaaattaaaaccggacttaattgtcgcgtcaaaagttagaaatgaaaaagtttacgatcaattatctaaaatcgcaccaacagtttctactgatacagttttcaaattcaaagatacaactaagttaatggggaaagctttagggaaagaaaaagaagctgaagatttacttaaaaagtacgatgataaagtagctgcattccaaaaagatgcaaaagcaaagtataaagatgcatggccattgaaagcttcagttgttaacttccgtgctgatcatacaagaatttatgctggtggatatgctggtgaaatcttaaatgatttaggattcaaacgtaataaagacttacaaaaacaagttgataatggtaaagatattatccaacttacatctaaagaaagcattccattaatgaacgctgatcatatttttgtagtaaaatcagatccaaatgcgaaagatgctgcattagttaaaaagactgaaagcgaatggacttcaagtaaagagtggaaaaatttagacgcagttaaaaacaaccaagtatctgatgatttagatgaaatcacttggaacttagctggcggatataaatcttcattaaaacttattgacgatttatatgaaaagttaaatattgaaaaacaatcaaaataa

SEQ ID NO: 455 - DNA, 993 bp, Staphylococcus aureus
atgaataaagtaattaaaatgcttgttgttacgcttgctttcctacttgttttagcaggatgtagtgggaattcaaataagcaatcatctgatagcaaagataaggaaacaacttcaattaaacatgcaatgggtacaactgaaattaaagggaaaccaaagcgcgttgttacactatatcaaggtgccactgacgtcgctgtatctttaggtgttaaacctgtaggtgctgtagaatcatggacacaaaaaccgaaattcgaatacataaaaaatgatttaaaagatactaagattgtaggtcaagaacctgcacctaacttagaagaaatctctaaattaaaaccggacttaattgtcgcgtcaaaagttagaaatgaaaaagtttacgatcaattatctaaaatcgcaccaacagtttctactgatacagttttcaaattcaaagatacaactaagttaatggggaaagctttagggaaagaaaaagaagctgaagatttacttaaaaagtacgatgataaagtagctgcattccaaaaagatgcaaaagcaaagtataaagatgcatggccattgaaagcttcagttgttaacttccgtgctgatcatacaagaatttatgctggtggatatgctggtgaaatcttaaatgatttaggattcaaacgtaataaagacttacaaaaacaagttgataatggtaaagatattatccaacttacatctaaagaaagcattccattaatgaacgctgatcatatttttgtagtaaaatcagatccaaatgcgaaagatgctgcattagttaaaaagactgaaagcgaatggacttcaagtaaagagtggaaaaatttagacgcagttaaaaacaaccaagtatctgatgatttagatgaaatcacttggaacttagctggcggatataaatcatcattaaaacttattgacgatttatatgaaaagttaaatattgaaaaacaatcaaaataa

SEQ ID NO: 456 - DNA, 993 bp, Staphylococcus aureus
atgaataaagtaattaaaatgcttgttgttacgcttgctttcctacttgttttagcaggatgtagtgggaattcaaataaacaatcatctgataacaaagataaggaaacaacttcaattaaacatgcaatgggtacaactgaaattaaagggaaaccaaagcgtgttgttacgctatatcaaggtgccactgacgtcgctgtatctttaggtgttaaacctgtaggtgctgtagaatcatggacacaaaaaccgaaattcgaatacataaaaaatgatttaaaagatactaagattgtaggtcaagaacctgcacctaacttagaggaaatctctaaattaaaaccggacttaattgtcgcgtcaaaagttagaaatgaaaaagtttacgatcaattatctaaaatcgcaccaacagtttctactgatacagttttcaaattcaaagatacaactaagttaatggggaaagctttagggaaagaaaaagaagctgaagatttacttaaaaagtacgatgataaagtagctgcattccaaaaagatgcaaaagcaaagtataaagatgcatggccattgaaagcttcagttgttaacttccgtgctgatcatacaagaatttatgctggtggatatgctggtgaaatcttaaatgatttaggattcaaacgtaataaagacttacaaaaacaagttgataatggtaaagatattatccaacttacatccaaagaaagcattccattaatgaacgctgatcatatttttgtagtaaaatcagatccaaatgcgaaagatgctgcattagttaaaaagactgaaagcgaatggacttcaagtaaagaatggaaaaatttagacgcagttaaaaacaaccaagtatctgatgatttagatgaaatcacttggaacttagctggcggatataaatcatcattaaaattgattgacgatttatatgaaaagttaaatattgaaaaacaatcaaaataa

SEQ ID NO: 457 - DNA, 993 bp, Staphylococcus aureus; identical to SEQ ID NO: 454

SEQ ID NO: 458 - DNA, 993 bp, Staphylococcus aureus; identical to SEQ ID NO: 454

SEQ ID NO: 459 - DNA, 993 bp, Staphylococcus aureus; identical to SEQ ID NO: 454

SEQ ID NO: 460 - DNA, 993 bp, Staphylococcus aureus; identical to SEQ ID NO: 454

SEQ ID NO: 461 - DNA, 993 bp, Staphylococcus aureus; identical to SEQ ID NO: 454

SEQ ID NO: 462 - DNA, 993 bp, Staphylococcus aureus; identical to SEQ ID NO: 456

SEQ ID NO: 463 - DNA, 891 bp, Staphylococcus aureus
aaagaatcatcaactaaagatactatttcggtaaaagatgaaaatggtacagtaaaagtacctaaagatgcaaaacgtatcgttgtattagagtactcatttgcagatgcattagcagcattagacgttaaaccagttggtattgctgatgatggtaagaaaaaacgtatcattaaaccagttagagaaaaaattggggattatacttctgtaggtacacgtaaacagccaaacttagaggaaattagtaaattaaaaccggatttaattatcgctgatagcagtagacataaaggtattaataaagaattaaacaaaattgcaccaacattatcattaaagagttttgatggagactacaaacaaaacattaattcgttcaaaacaattgctaaagctttaaataaagaaaaagaaggcgaaaagcgtcttgctgaacatgataaattaatcaaaaagtataaagatgaaattaagtttgatagaaatcaaaaagtgcttccagcagttgttgctaaagctggtttattagcacatccaaactattcatatgttggacaatttttaaacgaacttggatttaaaaatgcattaagtgatgatgtaacaaaaggtttaagtaaatacttgaaaggaccttacttacaattagatactgaacatttagctgacttaaatcctgaacgcatgattattatgacagataatgctaaaaaagattctgctgaattcaagaagttacaagaagatccaacttggaaaaagttgaacgcagttaaaaataatcgcgtggatattgttgaccgtgatgtttgggcaagatctcgtggcttaatttcttctgaagaaatggctaaagaacttgttgaattatcaaaaaaagaacaaaag

SEQ ID NO: 464 - DNA, 1014 bp, Staphylococcus aureus
atgaagttatacatattaaggagtggaacgatgagaggtctaaaaacttttagtatattgggattaatagttgccttatttttagttgcagcttgtggtaatacggataattcaagtaaaaaagaatcatcaactaaagatactatttcggtaaaagatgaaaatggcacagtaaaagtacctaaagatgcaaaacgtatcgttgtattagagtactcatttgcagatgcattagcagcattagacgttaaaccagttggtattgctgatgatggtaagaaaaaacgtatcattaaaccagttagagaaaaaattggggattatacttctgtaggtacacgtaaacagccaaacttagaggaaattagtaaattaaaaccggatttaattatcgctgatagcagtagacataaaggtattaataaagaattaaacaaaattgcaccaacattatcattaaagagttttgatggagactacaaacaaaacattaattcgttcaaaacaattgctaaagctttaaataaagaaaaagaaggcgaaaagcgtcttgctgaacatgataaattaatcaaaaagtataaagatgaaattaagtttgatagaaatcaaaaagtgcttccagcagttgttgctaaagctggtttattagcacatccaaactattcatatgttggacaatttttaaacgaacttggatttaaaaatgcattaagtgatgatgtaacaaaaggtttaagtaaatacttgaaaggaccttacttacaattagatactgaacatttagctgacttaaatcctgaacgcatgattattatgacagataatgctaaaaaagattctgctgaattcaagaagttacaagaagatccaacttggaaaaagttgaatgcagttaaaaataatcgcgtggatattgttgaccgtgatgtttgggcaagatctcgtggcttaatttcttctgaagaaatggctaaagaacttgttgaattatcaaaaaaagaacaaaagtaa

SEQ ID NO: 465 - DNA, 984 bp, Staphylococcus aureus
atgagaggtctaaaaacttttagtatattgggattaatagttgccttacttttagttgcagcttgtggtaatacggataattcaagtaaaaaagaatcatcaactaaagatactatttcggtaaaagatgaaaatggtacagtaaaagtacctaaagatgcaaaacgtatcgttgtattagagtactcatttgcagatgcattagcagcattagacgttaaaccagttggtattgctgatgatggtaagaaaaaacgtatcattaaaccagttagagaaaaaattggggattatacttctgtaggtacacgtaaacagccaaacttagaggaaattagtaaattaaaaccggatttaattatcgctgatagcagtagacataaaggtattaataaagaattaaacaaaattgcaccaacattatcattaaagagttttgatggagactacaaacaaaatattaattcgttcaaaacaattgctaaagctttaaataaagaaaaagaaggcgaaaaacgtcttgctgagcatgataaattaatcaataagtataaagatgaaattaaatttgatagaaatcaaaaagtgcttccagcagtagttgctaaagctggtttattagcacatccaaactattcatatgttggacaatttttaaacgaactaggatttaaaaatgcattaagtgacgatgtaacaaaaggtttaagtaaatatttgaaaggaccttacttacaattagacactgaacatttagctgatttaaatccagagcgtatgatcattatgacagatcatgctaaaaaagattctgctgaattcaagaagttacaagaagatgcaacatggaaaaagttgaatgcagttaaaaataatcgcgtggatattgttgaccgtgatgtttgggcaagatctcgtggcttaatttcttctgaagaaatggctaaagaacttgttgaattatcaaaaaaagaacaaaagtaa

SEQ ID NO: 466 - DNA, 984 bp, Staphylococcus aureus
atgagaggtctaaaaacttttagtatattgggattaatagttgccttatttttagttgcagcttgtggtaatacggataattcaagtaaaaaagaatcatcaactaaagatactatttcggtaaaagatgaaaatggtacagtaaaagtacctaaagatgcaaaacgtatcgttgtattagagtactcatttgcagatgcattagcagcattagacgttaaaccagttggtattgctgatgatggtaagaaaaaacgtatcattaaaccagttagagaaaaaattcgggattatacttctgtaggtacacgtaaacagccaaacttagaggaaattagtaaattaaaaccggatttaattatcgctgatagcagtagacataaaggtattaataaagaattaaacaaaattgcaccaacattatcattaaagagttttgatggtgactacaagcaaaatatcgatgctttcaagacaattgcgaaagctttagataaagaaaaagaaggcgaaaaacgtcttgctgaacatgataaattaatcaataagtataaagatgaaattaaatttgatagaaatcaaaaagtgcttccagcagttgttgcgaaagctggtttattagcacatccaaactattcgtatgttggacaatttttaaacgaacttggatttaaaaatgcattaagtgatgatgtaacaaaaggtttaagtaaatacttgaaaggaccttacttacaattagatactgaacatttagctgacttaaatcctgaacgcatgattattatgacagataatgctaaaaaagattctgctgaattcaagaagttacaagaagatgcaacatggaaaaaattgaatgcagttaaaaataatcgtgttgatattgttgaccgtgatgtttgggcaagatctcgtggcttaatttcttctgaagaaatggctaaagaacttgttgaattatcaaaaaaagaacaaaagtaa

SEQ ID NO: 467 - DNA, 984 bp, Staphylococcus aureus
atgagaggtctaaaaacttttagtatattgggattaatagttgccttacttttagttgcagcttgtggtaatacggataattcaagtaaaaaagaatcatcaactaaagatactatttcggtaaaagatgaaaatggtacagtaaaagtacctaaagatgcaaaacgtatcgttgtattagagtactcatttgcagatgcattagcagcattagacgttaatccagttggtattgctgatgatggtaagaaaaaacgtatcattaaaccagttagagaaaaaattggggattatacttctgtaggtacacgtaaacagccaaacttagaagaaattagtaaattaaaaccggatttaattatcgctgatagcagtagacataaaggtattaataaagaattaaacaaaattgcaccaacattatcattaaagagttttgatggagactacaaacaaaacattaattcgttcaaaacaattgctaaagctttaaataaagaaaaagaaggcgaaaaacgtcttgctgagcatgataaattaatcaataagtataaagatgaaattaaatttgatagaaatcaaaaagtgcttccagcagtagttgctaaagctggtttattagcacatccaaactattcatatgttggacaatttttaaacgaactaggatttaaaaatgcattaagtgacgatgtaacaaaaggtttaagtaaatatttgaaaggaccttacttacaattagacactgaacatttagctgatttaaatccagagcgtatgatcattatgactgatcacgctaaaaaagattctgctgaattcaagaaattacaagaagatgcaacatggaaaaaattgaatgcagttaaaaataatcgcgtggatattgttgaccgtgatgtttgggcaagatctcgtggcttaatttcttctgaagaaatggctaaagaacttgttgaattatcaaaaaaagaacaaaagtaa

SEQ ID NO: 468 - DNA, 984 bp, Staphylococcus aureus
atgagaggtctaaaaacttttagtatattgggattaatagttgccttacttttagttgcagcttgtggtaatacggataattcaagtaaaaaagaatcatcaactaaagatactatttcggtaaaagatgaaaatggtacagtaaaagtacctaaagatgcaaaacgtatcgttgtattagagtactcatttgcagatgcattagcagcattagacgttaaaccagttggtattgctgatgatggtaagaaaaaacgtatcattaaaccagttagagaaaaaattggggattatacttctgtaggtacacgtaaacagccaaacttagaagaaattagtaaattaaaaccggatttaattatcgctgatagcagtagacataaaggtattaataaagaattaaacaaaattgcaccaacattatcattaaagagttttgatggagactacaaacaaaatattaattcgttcaaaacaattgctaaagctttaaataaagaaaaagaaggcgaaaaacgtcttgctgagcatgataaattaatcaataagtataaagatgaaattaaatttgatagaaatcaaaaagtgcttccagcagtagttgctaaagctggtttattagcacatccaaactattcatatgttggacaatttttaaacgaactaggatttaaaaatgcattaagtgacgatgtaacaaaaggtttaagtaaatatttgaaaggaccttacttacaattagacactgaacatttagctgatttaaatccagagcgtatgatcattatgacagatcatgctaaaaaagattctgctgaattcaagaagttacaagaagatgcaacatggaaaaagttgaatgcagttaaaaataatcgcgtggatattgttgaccgtgatgtttgggcaagatctcgtggcttaatttcttctgaagaaatggctaaagaacttgttgaattatcaaaaaaagaacaaaagtaa

SEQ ID NO: 469 - DNA, 984 bp, Staphylococcus aureus; identical to SEQ ID NO: 465

SEQ ID NO: 470 - DNA, 984 bp, Staphylococcus aureus; identical to SEQ ID NO: 468

SEQ ID NO: 471 - DNA, 984 bp, Staphylococcus aureus; identical to SEQ ID NO: 468

SEQ ID NO: 472 - DNA, 984 bp, Staphylococcus aureus; identical to SEQ ID NO: 468

SEQ ID NO: 473 - DNA, 984 bp, Staphylococcus aureus; identical to SEQ ID NO: 467

SEQ ID NO: 474 - DNA, 882 bp, Staphylococcus aureus
actgaagagaaaactgaaatgacgacaataaaagatgaattaggaactgaaaaaattaagaaaaatcctaaacgtgttgttgtattagaatatagttttgctgattatttagcagcattagatatgaaacctgttggtattgcagatgatggcagcagtaaaaatataacaaagtcagtaagagataagattggggcatatgaatcggttggatctagatcgcaaccgaatatggaagtgataagtaaattaaaaccggatttgatcattgcagatgtcagcagacataagaaaatcaaatcagaattgagcaaaattgcgccgacaattatgttagtcagtggtacgggagattacaatgcaaatattgaagcatttaaaacagtcgctaaagcagttggcagagagaaagaaggcgaaaagcgtctggaaaagcatgataaaatattagcggagattagaaagaaaattgaacagagtacgttaaaatctgcatttgcacttggtatctcaagagcaggtatgtttattaataatgaagatacatttatgggacaatttttaattaaaatgggtattcaacctgaagtcacaaaagacaaaactgcgcatgtgggtgaacgcaagggtggcccttatatttatttaaataatgaagagcttgccaatatcaatccaaaagttatgattttagccactgacggaaaaacggacaaaaatagaacgaaattcattgatcctgcagtttggaaatcattaaaagctgtgaaagataacaaagtttatgacgttgaccgaaataagtggttgaaatcaaggggtattatcgcaagtgaaagtatggcagaagatttagaaaaaattgcagaaaaagcaaaataa

SEQ ID NO: 475 - DNA, 651 bp, Staphylococcus aureus
atggaagtgataagtaaattaaaaccggatttgatcattgcagatgttaacagacataagaaaatcaaatcagaattgagcaaaattgctccgacaatcatgttagttagcggtacgggagattataatgcaaatattgaagcatttaaaacagttgctaaagcagtaggcaaagagaaagaaggcgagaaacgtctggaaaagcatgataaaatattagcggagattagaaagaaaattgaacagagtacgttaaaatctgcatttgcattcggtatctcaagagcaggtatgtttattaataatgaagatacatttatgggacaattcttaattaaaatgggtattcaacctgaagtcacaaaagacaaaactatgcatgttggtgaacgcaagggtggtccttatatttatttaaataatgaagaacttgccaatatcaatccaaaagttatgattttagccactgacggaaaaacggacaaaaatagaacgaaattcattgatcctgcagtttggaaatcattaaaagctgtgaaagataacaaagtttatgacgttgaccgaaataagtggttgaaatcaaggggtattatcgcaagtgaaagtatggcagaagatttagaaaaaattgcagaaaaagcaaaataa

SEQ ID NO: 476 - DNA, 960 bp, Staphylococcus aureus
gtgaataggaatatcgttaaattagttgtgtttatgctaatcttagttgtagcagtagcgggttgtggtcaaaaagatactgaagagaaaactgaaatgacgacaataaaagatgaattaggaactgaaaaaattaagaaaaatcctaaacgtgttgttgtattagaatatagttttgctgattatttagcagcattagatatgaaacctgttggtattgcagatgatggcagcactaaaaatataacaaagtcagtaagagataagattggggcatatgaatcggttggatctagaccgcaaccgaatatggaagtgataagtaaattaaaaccggatttgatcattgcagatgttagcagacataagaaaatcaaatcagaattgagcaaaattgctccgacaatcatgttagttagcggtacgggagattataatgcaaatattgaagcatttaaaacagtcgctaaagcagtaggcaaagagaaagaaggcgagaagcgtctggaaaagcatgataaaatattagcggagattagaaagaaaattgaacagagtacgttaaaatctgcatttgcattcggtatctcaagagcaggtatgtttattaataatgaagatacatttatgggacaattcttaattaaaatgggtattcaacctgaagtcacaaaagacaaaactacgcatgttggtgaacgcaagggtggtccttatatatatttaaataatgaagaacttgccaatatcaatccaaaagttatgattttagccactgacggaaaaacggacaaaaatagaacgaaattcattgatcctgcagtttggaaatcattaaaagctgtgaaagataacaaagtttatgacgttgaccgaaataagtggttgaaatcaagggggattatcgcaagtgaaagtatggcagaagatttagaaaaaattgcagaaaaagcaaaataa

SEQ ID NO: 477 - DNA, 960 bp, Staphylococcus aureus
gtgaataggaatatcgttaaattagttgtgtttatgctaatcttagttgtagcagtagcgggttgtggtcaaaaagatactgaagagaaaactgaaatgacgacgataaaagatgaattaggaactgaaaaaattaagaaaaatccgaaacgtattgttgtattagaatatagttttgctgattatttagcagcattagatatgaaacctgttggtattgcagatgatggtagtactaaaaatataacaaagtcagtaagagataagattggggcatatgaatcggttggatctagaccgcaaccgaatatggaagtgataagtaaattaaaaccggatttgattattgcagatgtcagcagacataagaaaatcaaatcagaattgagcaaaattgcgccgacaatcatgttagttagcggtacgggagattacaatgcaaatattgaagcatttaaaacagtcgctaaagcagttggcaaagagaaagaaggcgaaaagcgtctggaaaagcataataaaatattagcggagattagaaagaaaattgaacagagtacgttaaaatctgcatttgcatttggtatctcaagagcaggtatgtttattaataatgaagatacatttatgggacaattcttaattaaaatgggtattcaacctgaagtcacaaaagacaaaactgcgcatgttggtgaacgcaagggtggcccttatatttatttaaataatgaagagcttgccaatatcaatccaaaagttatgattttagctacgaatggaaaaacagataaaaatagaacgaaattcattgatcctgcagtttggaaatcattaaaagctgtgaaagataataaagtatatgatgttgatcgaaataagtggttgcaatcaagaggtattatggcaagtgaaagtatggcagaagatttagaaaaaattgcagaaaaagcaaaataa

SEQ ID NO: 478 - DNA, 960 bp, Staphylococcus aureus
gtgaataggaatatcgttaaactagttgtgtttatgctaatcttagttgtagcagtagcgggttgtggtcaaaaagatactgaagagaaaactgaaatgacgacaataaaagatgaattaggaactgaaaaaattaagaaaaatcctaaacgtgttgttgtattagaatatagttttgctgattatttagcagcattagatatgaaacctgttggtattgcagatgatggcagcagtaaaaatataacaaagtcagtaagagataagattggggcatatgaatcggttggatctagaccgcaaccgaatatggaagtgataagtaaattaaaaccggatttgatcattgcagatgttagcagacataagaaaatcaaatcagaattgagcaaaattgcgccgacaattatgttagtcagtggtacgggagattacaatgcaaatattgaagcatttaaaacagtcgctaaagcagttggcaaagagaaagaaggcgagaagcgtctggaaaagcatgataaaatattagcggagattagaaagaaaattgaacagagtacgttaaaatctgcatttgcattcggtatctcaagagcaggtatgtttattaataatgaagatacatttatgggacaattcttacttaaaatgggtattcaacctgaagtcacaaaagacaaaactacgcatgttggtgaacgcaagggtggtccttatatatatttaaataatgaagaacttgccaatatcaatccaaaagttatgattttagccactgacgggaaaacggacaaaaatagaacgaaattcattgatcctgcagtttggaaatcattaaaagctgtgaaagataacaaagtttatgacgttgaccgaaataagtggttgaaatcaagggggattatcgcaagtgaaagtatggcagaagatttagaaaaaattgcagaaaaagcaaaataa

SEQ ID NO: 479 - DNA, 960 bp, Staphylococcus aureus
gtgaataggaatatcgttaaactagttgtgttcatgctaattttagttgtagcagtagcgggttgtggtcaaaaagatactgaagagaaaactgaaatgacgacaataaaagatgaattaggaactgaaaaaattaagaaaaatcctaaacgtgttgttgtattagaatatagttttgctgattatttagcagcattagatatgaaacctgttggtattgcagatgatggcagcactaaaaatataacaaagtcagtaagagataagattggggcatatgaatcggttggatctagaccgcaaccgaatatggaagtgataagtaaattaaaaccggatttgatcattgcagatgttagcagacataagaaaatcaaatcagaattgagcaaaattgctccgacaatcatgttagttagcggtacgggagattataatgcaaatattgaagcatttaaaacagtcgctaaagcagtaggcaaagagaaagaaggcgagaagcgtctggaaaagcatgataaaatattagcggagattagaaagaaaattgaacagagtacgttaaaatctgcatttgcattcggtatctcaagagcaggtatgtttattaataatgaagatacatttatgggacaattcttaattaaaatgggtattcaacctgaagtcacaaaagacaaaactacgcatgttggtgaacgcaagggtggtccttatatatatttaaataatgaagaacttgccaatatcaatccaaaagttatgattttagccactgacggaaaaacggacaaaaatagaacgaaattcattgatcctgcagtttggaaatcattaaaagctgtgaaagataacaaagtttatgacgttgaccgaaataagtggttgaaatcaagggggattatcgcaagtgaaagtatggcagaagatttagaaaaaattgcagaaaaagcaaaataa

SEQ ID NO: 480 - DNA, 960 bp, Staphylococcus aureus; identical to SEQ ID NO: 476

SEQ ID NO: 481 - DNA, 864 bp, Staphylococcus aureus
atgacgacaataaaagatgaattaggaactgaaaaaattaagaaaaatcctaaacgtgttgttgtattagaatatagttttgctgattatttagcagcattagatatgaaacctgttggtattgcagatgatggcagcactaaaaatataacaaagtcagtaagagataagattggggcatatgaatcggttggatctagaccgcaaccgaatatggaagtgataagtaaattaaaaccggatttgatcattgcagatgttagcagacataagaaaatcaaatcagaattgagcaaaattgctccgacaatcatgttagttagcggtacgggagattataatgcaaatattgaagcatttaaaacagtcgctaaagcagtaggcaaagagaaagaaggcgagaagcgtctggaaaagcatgataaaatattagcggagattagaaagaaaattgaacagagtacgttaaaatctgcatttgcattcggtatctcaagagcaggtatgtttattaataatgaagatacatttatgggacaattcttaattaaaatgggtattcaacctgaagtcacaaaagacaaaactacgcatgttggtgaacgcaagggtggtccttatatatatttaaataatgaagaacttgccaatatcaatccaaaagttatgattttagccactgacggaaaaacggacaaaaatagaacgaaattcattgatcctgcagtttggaaatcattaaaagctgtgaaagataacaaagtttatgacgttgaccgaaataagtggttgaaatcaagggggattatcgcaagtgaaagtatggcagaagatttagaaaaaattgcagaaaaagcaaaataa

SEQ ID NO: 482 - DNA, 960 bp, Staphylococcus aureus; identical to SEQ ID NO: 479

SEQ ID NO: 483 - DNA, 864 bp, Staphylococcus aureus; identical to SEQ ID NO: 481

SEQ ID NO: 484 - DNA, 960 bp, Staphylococcus aureus; identical to SEQ ID NO: 478

SEQ ID NO: 485 - DNA, 807 bp, Staphylococcus aureus
ggtagcgacgataatggctcgtctaaatcgccgtaccatagaattgtttcgttaatgcctagtaatactgaaattttatatgaattaggattaggtaaatacatagttggtgtttcaacggttgatgattatccaaaagatgtgaaaaagggtaagaaacaatttgatgctttgaatctaaataaagaggaacttttaaaggcaaagccagatctaattcttgcgcatgagtcgcaaaaggcaactgcaaataaagtattgtcatcattagagaaacaaggcatcaaagtagtgtatgttaaagatgcacaatcaattgatgaaacttacaacacatttaagcaaattgggaaattaacgcatcatgataagcaggctgaacaacttgttgaggaaactaaagataatatcgataaagtcatagattcaattcctgctcatcataaaaaatcaaaagtatttattgaggtttcatcaaagcctgaaatatatacagcagggaagcatacatttttcaatgatatgttagaaaaattagaagcccaaaatgtttatagtgacattaatggttggaaccctgtaacgaaggaaagtattattaaaaagaacccagatatattaatttcgacggaagctaagacaagatcagattatatggatatcatcaaaaaaagaggtggattcaataaaattaatgctgtcaagaatacacgtattgaagttgtaaatggtgatgaagtgtcaagaccaggtccacgtattgatgaaggattaaaagaattaagagatgcaatttatagaaaataa

SEQ ID NO: 486 - DNA, 888 bp, Staphylococcus aureus
gtgaagaaatcgttaattgcttttattttgatttttatgcttgttctgagtggctgtggtatgaaagataatgataaacaaggtagcgatgataatggctcgtctaaatcgccgtaccatagaattgtttcgttaatgcctagtaatactgaaattttatatgaattaggattaggtaaatacatagttggtgtttcaacggttgatgattatccaaaagatgtgaaaaagggtaagaaacaatttgatgctttgaatctaaataaagaggaacttttaaaggcaaagccagatctaattcttgcgcatgagtcgcaaaaggcaactgctaataaagtattgtcatcattagagaaacaaggcatcaaagtagtgtatattaaagatgcacaatcaattgatgaaacttacaacacatttaagcaaattgggaaattaacgcatcatgataagcaggctgaacaacttgttgaggaaactaaagataatatcgataaagtcatagattcaattcctgctcatcataaaaaatcaaaagtatttattgaggtttcatcaaagcctgaaatatatacagcagggaagcatacatttttcaatgatatgttagaaaaattagaagcccaaaatgtttatagtgacattaatggttggaaccctgtaacgaaggaaagtattattaaaaagaacccagatatattaatttcgacggaagctaagacaagatcagattatatggatatcatcaaaaaaagaggtggattcaataaaattaatgctgtcaagaatacacgtattgaagtagtaaatggtgatgaagtatcaagaccaggtccacgtattgatgaaggattaaaagaattaagagatgcaatttatagaaaataa

SEQ ID NO: 487 - DNA, 888 bp, Staphylococcus aureus
gtgaagaaatcgttaattgcttttattttgatttttatgcttgtcctgagtggctgtggtatgaaagataatgataaacaaggtagcgatgataatggctcgtctaaatcgccgtaccatagaattgtttcgttaatgcctagtaatactgaaattttatatgaattaggattaggtaaatacatagttggtgtttcaacggttgatgattatccaaaagatgtgaaagagggtaagaaacaatttgatgctttgaatctaaataaagaggaacttttaaaggcaaagccagatctaattcttgcgcatgagtcgcaaaaggcaactgctaataaagtattgtcatcattagagaaacaaggcatcaaagtagtgtatgttaaagatgcacaatcaattgatgaaacatacaacacatttaagcaaattgggaaattaacgcatcatgataagcaggctgaacaacttgttgaggaaactaaagataatatcgataaagtcatagattcaattcctgctcatcataaaaaatcaaaagtatttattgaggtttcatcaaagcctgaaatatatacagcagggaagcatacattttttaatgatatgttagaaaaattagaagcccaaaatgtttatagtgacattaatggttggaaccctgtaacgaaggaaagtattattaaaaagaacccagatatattaatttcgacggaagctaagacaagatcagattatatggatatcatcaaaaaaaggggtggattcaataaaattaatgctgtcaagaatacacgtattgaagttgtaaatggtgatgaagtatcaagaccaggtccacgtattgatgaaggattaaaagaattaagagatgcaatttatagaaaataa

SEQ ID NO: 488 - DNA, 888 bp, Staphylococcus aureus
gtgaagaaatcgttaattgcttttattttgatttttatgcttgttctgagtggctgtggtatgaaagataatgataaacaaggtagcgacgataatggctcgtctaaatcgccgtaccatagaattgtttcgttaatgcctagtaatactgaaattttatatgaattaggattaggtaaatacatagttggtgtttcaacggttgatgattatccaaaagatgtgaaaaagggtaagaaacaatttgatgctttgaatctaaataaagaggaacttttaaaggcaaagccagatctaattcttgcgcatgagtcgcaaaaggcaactgctaataaagtattgtcatcattagagaaacaaggcatcaaagtagtgtatgttaaagatgcacaatcaattgatgaaacttacaacacatttaagcaaattgggaaattaacgcatcatgaaaagcaggctgaacaacttgttgaggaaactaaggataatatcgataaagtcatagattcaattcctgctcatcataaaaaatcaaaagtatttattgaggtttcatcaaagcctgaaatatatacagcagggaagcatacatttttcaatgatatgttagaaaaattagaagcccaaaatgtttatagtgacattaatggttggaaccctgtaacgaaggaaagtattattaaaaagaacccagatatattaatttcgacggaagctaagacaagatcagattatatggatatcatcaaaaaaagaggtggattcaataaaattaatgctgtcaagaatacacgtattgaagttgtaaatggtgatgaagtatcaagaccgggtccacgtattgatgaaggattaaaagaattaagagatgcaatttatagaaaataa

SEQ ID NO: 489 - DNA, 888 bp, Staphylococcus aureus
gtgaagaaatcgttaattgcttttattttgatttttatgcttgtcctgagtggctgtggtatgaaagataatgataaacaaggtagcaatgataatggctcgtctaaatcgccgtaccatagaattgtttcgttaatgcctagtaatactgaaattttatatgaattaggattaggtaaatacatagttggtgtttcaacggttgatgattatccaaaagatgtgaaagagggtaagaaacaatttgatgctttgaatctaaataaagaggaacttttaaaggaaaagccagatctaattcttgcgcatgagtcgcaaaaggcaactgctaataaagtattgtcatcattagagaaacaaggcatcaaagtagtgtatgttaaagatgcacaatcaattgatgaaacatacaacacatttaagcaaattgggaaattaacgcatcatgataagcaggctgaacaacttgttgaggaaactaaagataatatcgataaagtcatagattcaattcctgctcatcataaaaaatcaaaagtatttattgaggtttcatcaaagcctgaaatatatacagcaggaaagcatacatttttcaatgatatgttagaaaaattagaagcccaaaatgtttatagtgacattaatggttggaaccctgtaacgaaggaaagtattattaaaaagaacccagatatattaatttcgacggaagctaagacaagatcagattatatggatatcatcaaaaaaagaggtggattcaataaaattaatgctgtcaagaatacacgtattgaagttgtaaatggtgatgaagtatcaagacccggtccacgtattgatgaaggattaaaagaattaagagatgcaatttatagaaaataa

SEQ ID NO: 490 - DNA, 888 bp, Staphylococcus aureus
gtgaagaaatcgttaattgcttttattttgatttttatgcttgtcctgagtggctgtggtatgaaagataatgataaacaaggtagcaatgataatggctcgtctaaatcgccgtaccatagaattgtttcgttaatgcctagtaatactgaaattttatatgaattaggattaggtaaatacatagttggtgtttcaacggttgatgattatccaaaagatgtgaaaaagggtaagaaacaatttgatgctttgaatctaaataaagaggaacttttaaaggcaaagccagatctaattcttgcgcatgagtcgcaaaaggcaactgctaataaagtattgtcatcattagagaaacaaggcatcaaagtagtgtatgttaaagatgcacaatcaattgatgaaacttacaacacatttaagcaaattgggaaattaacgcatcatgataagcaggctgaacaacttgttgaggaaactaaagataatatcgataaagtcatagattcaattcctgctcatcataaaaaatcaaaagtatttattgaggtttcatcaaagcctgaaatatatacagcagggaagcatacattttttaatgatatgttagaaaaattagaagcccaaaatgtgtatagtgacattaatggttggaaccctgtaacgaaggaaagtattattaaaaagaacccagatatattaatttcgacggaagctaagacaagatcagattatatggatatcatcaaaaaaagaggtggattcaataaaattaatgctgtcaagaatacacgtattgaagttgtaaatggtgatgaagtatcaagaccaggtccacgtattgatgaaggattaaaagaattaagagatgcaatttatagaaaataa

SEQ ID NO: 491 - DNA, 888 bp, Staphylococcus aureus; identical to SEQ ID NO: 487

SEQ ID NO: 492 - DNA, 828 bp, Staphylococcus aureus
atgaaagataatgataaacaaggtagcaatgataatggctcgtctaaatcgccgtaccatagaattgtttcgttaatgcctagtaatactgaaattttatatgaattaggattaggtaaatacatagttggtgtttcaacggttgatgattatccaaaagatgtgaaaaagggtaagaaacaatttgatgctttgaatctaaataaagaggaacttttaaaggcaaagccagatctaattcttgcgcatgagtcgcaaaaggcaactgctaataaagtattgtcatcattagagaaacaaggcatcaaagtagtgtatgttaaagatgcacaatcaattgatgaaacttacaacacatttaagcaaattgggaaattaacgcatcatgataagcaggctgaacaacttgttgaggaaactaaagataatatcgataaagtcatagattcaattcctgctcatcataaaaaatcaaaagtatttattgaggtttcatcaaagcctgaaatatatacagcagggaagcatacattttttaatgatatgttagaaaaattagaagcccaaaatgtgtatagtgacattaatggttggaaccctgtaacgaaggaaagtattattaaaaagaacccagatatattaatttcgacggaagctaagacaagatcagattatatggatatcatcaaaaaaagaggtggattcaataaaattaatgctgtcaagaatacacgtattgaagttgtaaatggtgatgaagtatcaagaccaggtccacgtattgatgaaggattaaaagaattaagagatgcaatttatagaaaataa

SEQ ID NO: 493 - DNA, 888 bp, Staphylococcus aureus; identical to SEQ ID NO: 490

SEQ ID NO: 494 - DNA, 828 bp, Staphylococcus aureus; identical to SEQ ID NO: 492

SEQ ID NO: 495 - DNA, 888 bp, Staphylococcus aureus; identical to SEQ ID NO: 489

SEQ ID NO: 496 - DNA, 855 bp, Staphylococcus aureus
agtgataagtcaaatggcaaactaaaagtagtaacgacgaattcaattttatatgatatggctaaaaatgttggtggagacaacgtcgatattcatagtattgtacctgttggtcaagatcctcatgaatatgaagttaaacctaaagatattaaaaagttaactgacgctgacgttattttatacaacggattaaatttagagactggtaacggttggtttgaaaaagccttagaacaggctggtaaatcattaaaagataaaaaagttatcgcagtatcaaaagatgttaaacctatctatttaaacggtgaagaaggcaacaaagataaacaagatccacacgcatggttaagtttagataacggtattaaatacgtaaaaacaattcaacaaacatttatcgataacgacaaaaaacataaagcagattatgaaaagcaaggtaacaaatacattgctcaattggaaaaattaaataatgacagtaaagacaaatttaatgacattccaaaagaacaacgtgccatgattacaagtgaaggtgccttcaagtacttctcaaaacaatacggtattacaccaggttatatttgggaaattaacactgaaaaacaaggtacaccagaacaaatgagacaagctattgagtttgttaaaaagcacaaattaaaacacttattagtagaaacaagtgttgataagaaagcaatggaaagtttatctgaagaaacgaagaaagatatctttggtgaagtgtacacagattcaatcggtaaagaaggcactaaaggtgactcttactacaaaatgatgaaatcaaatattgaaactgtacacggaagcatgaaataa

SEQ ID NO: 497 - DNA, 930 bp, Staphylococcus aureus
atgaaaaaattagtacctttattattagccttattacttctagttgctgcatgtggtactggtggtaaacaaagcagtgataagtcaaatggcaaattaaaagtagtaacgacgaattcaattttatatgatatggctaaaaatgttggtggagacaacgtcgatattcatagtattgtacctgttggtcaagatcctcatgaatatgaagttaaacctaaagatattaaaaagttaactgacgctgacgttattttatacaacggattaaatttagagactggtaacggttggtttgaaaaagccttagaacaggctggtaaatcattaaaagataaaaaagttatcgcagtatcaaaagatgttaaacctatctatttaaacggtgaagaaggcaacaaagataaacaagatccacacgcatggttaagtttagataacggtattaaatacgtaaaaacaattcaacaaacatttatcgataacgacaaaaaacataaagcagattatgaaaagcaaggtaacaaatacattgctcaattggaaaaattaaataatgacagtaaagacaaatttaatgacattccaaaagaacaacgtgccatgattacaagtgaaggtgccttcaagtacttctcaaaacaatacggtattacaccaggttatatttgggaaattaacactgaaaaacaaggtacaccagaacaaatgagacaagctattgagtttgttaaaaagcacaaattaaaacacttattagtagaaacaagtgttgataagaaagcaatggaaagtttatctgaagaaacgaagaaagatatctttggtgaagtgtacacagattcaatcggtaaagaaggcactaaaggtgactcttactacaaaatgatgaaatcaaatattgaaactgtacacggaagcatgaaataa

SEQ ID NO: 498 - DNA, 930 bp, Staphylococcus aureus
atgaaaaaattagtacctttattattagccttattacttctagttgctgcatgtggtactggtggtaaacaaagcagtgataagtcaaatggcaaattaaaagtagtaacgacgaattcaattttatatgatatggctaaaaatgttggtggagacaacgtcgatattcatagtattgtacctgttggtcaagatcctcatgaatatgaagttaaacctaaagatattaaaaagttaactgacgctgacgttattttatacaacggattaaatttagagactggtaacggttggtttgaaaaagccttagaacaggctggtaaatcattaaaagataaaaaagttatcgcagtatcaaaagatgttaaacctatctatttaaacggtgaagaaggcaacaaagataaacaagatccacacgcatggttaagtttagataatggtattaaatacgtaaaaacaattcaacaaacatttatcgataacgacaaaaaacataaagcagattatgaaaagcaaggtaacaaatacattgctcaattggaaaaattaaataatgacagtaaagacaaatttaatgacattccaaaagaacaacgtgccatgattacaagtgaaggtgccttcaagtacttctcaaaacaatacggtattacaccaggttatatttgggaaattaacactgaaaaacaaggtacacctgaacaaatgagacaagctattgagtttgttaaaaagcacaaattaaaacacttattagtagaaacaagtgttgataagaaagcaatggaaagtttatctgaagaaacgaagaaagatatctttggtgaagtgtacacagattcaatcggtaaagaaggcactaaaggtgactcttactacaaaatgatgaaatcaaatattgaaactgtacacggaagcatgaaataa

SEQ ID NO: 499 - DNA, 930 bp, Staphylococcus aureus
atgaaaaaattagtacctttattattagccttattacttttagttgctgcatgtggtactggtggtaaacaaagcagtgataagtcaaatggcaaactaaaagtagtaacgacgaattcaattttatatgatatggctaaaaatgttggtggagacaacgtcgatattcatagtattgtacctgttggtcaagatcctcatgaatatgaagttaaacctaaagatattaaaaagttaactgacgctgacgttattttatacaacggattaaatttagagactggtaacggttggtttgaaaaagccttagaacaggctggtaaatcattaaaagataaaaaagttatcgcagtatcaaaagatgttaaacctatctatttaaacggtgaagaaggcaacaaagataaacaagatccacacgcatggttaagtttagataacggtattaaatacgtaaaaacaattcaacaaacatttatcgataacgacaaaaaacataaagcagattatgaaaagcaaggtaacaaatacattgctcaattggaaaaattaaataacgacagtaaagacaaatttaatgacattccaaaagaacaacgtgccatgattacaagtgaaggtgccttcaagtacttctcaaaacaatacggtattacaccaggttatatttgggaaattaacactgaaaaacaaggtacaccagaacaaatgagacaagctattgagtttgttaaaaagcacaaattaaaacacttattagtagaaacaagtgttgataagaaagcaatggaaagtttatctgaagaaacgaagaaagatatctttggtgaagtgtacacagattcaatcggtaaagaaggcactaaaggtgactcttactacaaaatgatgaaatcaaatattgaaactgtacacggaagcatgaaataa

SEQ ID NO: 500 - DNA, 930 bp, Staphylococcus aureus
atgaaaaaattagtacctttattattagccttattacttctagttgctgcatgtggtactggtggtaaacaaagcagtgataagtcaaatggcaaattaaaagtagtaacgacgaattcaattttatatgatatggctaaaaatgttggtggagacaacgtcgatattcatagtattgtacctgttggtcaagatcctcatgaatatgaagttaaacctaaagatattaaaaagttaactgacgctgacgttattttatacaacggattaaatttagagactggtaacggttggtttgaaaaagccttagaacaggctggtaaatcattaaaagataaaaaagttatcgcagtatcaaaagatgttaaacctatctatttaaacggtgaagaaggcaacaaagataaacaagatccacacgcatggttaagtttagataacggtattaaatacgtaaaaacaattcaacaaacatttatcgataacgacaaaaaacataaagcagattatgaaaagcaaggtaacaaatacattgctcaattggaaaaattaaataatgacagtaaagacaaatttaatgacattccaaaagaacaacgtgccatgattacaagtgaaggtgccttcaagtacttctcaaaacaatacggtattacaccaggttatatttgggaaattaacactgaaaaacaaggtacacctgaacaaatgagacaagctattgagtttgttaaaaagcacaaattaaaacacttattagtagaaacaagtgttgataagaaagcaatggaaagtttatctgaagaaacgaagaaagatatctttggtgaagtgtacacagattcaatcggtaaagaaggcactaaaggtgactcttactacaaaatgatgaaatcaaatattgaaactgtacacggaagcatgaaataa

SEQ ID NO: 501 - DNA, 930 bp, Staphylococcus aureus; identical to SEQ ID NO: 500

SEQ ID NO: 502 - DNA, 930 bp, Staphylococcus aureus; identical to SEQ ID NO: 498

SEQ ID NO: 503 - DNA, 930 bp, Staphylococcus aureus; identical to SEQ ID NO: 500

SEQ ID NO: 504 - DNA, 930 bp, Staphylococcus aureus; identical to SEQ ID NO: 500

SEQ ID NO: 505 - DNA, 939 bp, Staphylococcus aureus
atgaaaaaattagtacctttattattagccttattacttctagttgctgcatgtggtactggtggtaaacaaagcagtgataagtcaaatggcaaattaaaagtagtaacgacgaattcaattttatatgatatggctaaaaatgttggtggagacaacgtcgatattcatagtattgtacctgttggtcaagatcctcatgaatatgaagttaaacctaaagatattaaaaagttaactgacgctgacgttattttatacaacggattaaatttagagactggtaacggttggtttgaaaaagccttagaacaggctggtaaatcattaaaagataaaaaagttatcgcagtatcaaaagatgttaaacctatctatttaaacggtgaagaaggcaacaaagataaacaagatccacacgcatggttaagtttagataacggtattaaatacgtaaaaacaattcaacaaacatttatcgataacgacaaaaaacataaagcagattatgaaaagcaaggtaacaaatacattgctcaattggaaaaattaaataatgacagtaaagacagtaaagacaaatttaatgacattccaaaagaacaacgtgccatgattacaagtgaaggtgccttcaagtacttctcaaaacaatacggtattacaccaggttatatttgggaaattaacactgaaaaacaaggtacacctgaacaaatgagacaagctattgagtttgttaaaaagcacaaattaaaacacttattagtagaaacaagtgttgataagaaagcaatggaaagtttatctgaagaaacgaagaaagatatctttggtgaagtgtacacagattcaatcggtaaagaaggcactaaaggtgactcttactacaaaatgatgaaatcaaatattgaaactgtacacggaagcatgaaataa

SEQ ID NO: 506 - DNA, 930 bp, Staphylococcus aureus; identical to SEQ ID NO: 500

SEQ ID NO: 507 - DNA, 30 bp, artificial
  synthetic oligonucleotide primer
gcaggcctttagaaacaaataaaaatcatg

SEQ ID NO: 508 - DNA, 33 bp, artificial
  synthetic oligonucleotide primer
tatggtaccttacatactttcatggaatgtacg

SEQ ID NO: 509 - DNA, 30 bp, artificial
  synthetic oligonucleotide primer
gcaggcctaaaaaagaaaacaagcaattaa

SEQ ID NO: 510 - DNA, 33 bp, artificial
  synthetic oligonucleotide primer
tatggtaccttatttatactgcatttcattgaa

SEQ ID NO: 511 - DNA, 30 bp, artificial
  synthetic oligonucleotide primer
gcaggccttcatctgatagcaaagataagg

SEQ ID NO: 512 - DNA, 33 bp, artificial
  synthetic oligonucleotide primer
tatggtaccttattttgattgtttttcaatatt

SEQ ID NO: 513 - DNA, 26 bp, artificial
  synthetic oligonucleotide primer
gcaggcctaaagaatcatcaactaaa

SEQ ID NO: 514 - DNA, 27 bp, artificial
  synthetic oligonucleotide primer
tatggtacccttttgttctttttttga

SEQ ID NO: 515 - DNA, 30 bp, artificial
  synthetic oligonucleotide primer
gcaggcctactgaagagaaaactgaaatga

SEQ ID NO: 516 - DNA, 33 bp, artificial
  synthetic oligonucleotide primer
tatggtaccttattttgctttttctgcaatttt

SEQ ID NO: 517 - DNA, 30 bp, artificial
  synthetic oligonucleotide primer
gcaggcctggtagcgacgataatggctcgt

SEQ ID NO: 518 - DNA, 33 bp, artificial
  synthetic oligonucleotide primer
tatggtaccttattttctataaattgcatctct

SEQ ID NO: 519 - DNA, 32 bp, artificial
  synthetic oligonucleotide primer
gcaggcctagtgataagtcaaatggcaaacta

SEQ ID NO: 520 - DNA, 32 bp, artificial
  synthetic oligonucleotide primer
tatggtaccttatttcatgcttccgtgtacag

SEQ ID NO: 521 - DNA, 32 bp, artificial
  synthetic oligonucleotide primer
gcaggccttcagaaactaaaggttctaaagat

SEQ ID NO: 522 - DNA, 32 bp, artificial
  synthetic oligonucleotide primer
tatggtaccttattttacaactttttcaagtt

SEQ ID NO: 523 - DNA, 32 bp, artificial
  synthetic oligonucleotide primer
gcaggcctactaaatcttataaaatggacgat

SEQ ID NO: 524 - DNA, 32 bp, artificial
  synthetic oligonucleotide primer
tatggtaccttattttgcagctttaattaatt

SEQ ID NO: 525 - DNA, 30 bp, artificial
  synthetic oligonucleotide primer
agaaggagatataccatgttagaaacaaat

SEQ ID NO: 526 - DNA, 33 bp, artificial
  synthetic oligonucleotide primer
ttaatgatgatgatgatgatgcatactttcatg

SEQ ID NO: 527 - DNA, 30 bp, artificial
  synthetic oligonucleotide primer
agaaggagatataccatgagaaaactaact

SEQ ID NO: 528 - DNA, 33 bp, artificial
  synthetic oligonucleotide primer
ttaatgatgatgatgatgatgtttatactgcat

SEQ ID NO: 529 - DNA, 30 bp, artificial
  synthetic oligonucleotide primer
ataaggagatataccatgaataaagtaatt

SEQ ID NO: 530 - DNA, 33 bp, artificial
  synthetic oligonucleotide primer
ttaatgatgatgatgatgatgttttgattgttt

SEQ ID NO: 531 - DNA, 37 bp, artificial
  synthetic oligonucleotide primer
agaaggaggatataccatgagaggtctaaaaactttt

SEQ ID NO: 532 - DNA, 39 bp, artificial
  synthetic oligonucleotide primer
ttaatgatgatgatgatgatgcttttgttctttttttga

SEQ ID NO: 533 - DNA, 37 bp, artificial
  synthetic oligonucleotide primer
agaaggaggatataccatgaataggaatatcgttaaa

SEQ ID NO: 534 - DNA, 39 bp, artificial
  synthetic oligonucleotide primer
ttaatgatgatgatgatgatgttttgctttttctgcaat

SEQ ID NO: 535 - DNA, 37 bp, artificial
  synthetic oligonucleotide primer
agaaggaggatataccatgaagaaatcgttaattgct

SEQ ID NO: 536 - DNA, 39 bp, artificial
  synthetic oligonucleotide primer
ttaatgatgatgatgatgatgttttctataaattgcatc

SEQ ID NO: 537 - DNA, 27 bp, artificial
  synthetic oligonucleotide primer
agaaggagatataccaaaaaattagta

SEQ ID NO: 538 - DNA, 33 bp, artificial
  synthetic oligonucleotide primer
ttaatgatgatgatgatgatgtttcatgcttcc

SEQ ID NO: 539 - DNA, 30 bp, artificial
  synthetic oligonucleotide primer
agaaggagatataccatgaagaaaacagtc

SEQ ID NO: 540 - DNA, 33 bp, artificial
  synthetic oligonucleotide primer
ttaatgatgatgatgatgatgttttacaacttt

SEQ ID NO: 541 - DNA, 30 bp, artificial
  synthetic oligonucleotide primer
agaaggagatataccatgaaaaaactatta

SEQ ID NO: 542 - DNA, 33 bp, artificial
  synthetic oligonucleotide primer
ttaatgatgatgatgatgatgttttgcagcttt

SEQ ID NO: 543 - protein, 333 aa, Staphylococcus aureus
MKKTVLYLVLAVMFLLAACGNNSDKEQSKSETKGSKETVKIENNYKMRGEKKDGSDAKKVKETVEVPKNPKNAVVLDYGALDVMKEMGLSDKVKALPNFLESFKDDKYTNIGNLKEVNFDKIAATKPEVIFISGRTANQKNLDEFKKAAPKAKIVYVGADEKNLIGSMKQNTENIGKIYDKEVKAKELNKDLDNKIASMKDKTKNFNKTVMYLLVNEGELSTFGPKGRFGGLVYDTLGFNAVDKKVSNSNHGQNVSNEYVNKENPDVILAMDRGQAVSGKSTAKQALNNPVLKNVKAIKEDKVYNLDPKLWYFAAGSTTTTIKQIEELDKVVK

SEQ ID NO: 544 - protein, 342 aa, Staphylococcus aureus
MKKTVLYLVLAVMFLLAACGNNSDKEQSKSETKGSKDTVKIENNYKMRGEKKDGSDAKKVKETVEVPKNPKNAVVLDYGALDVMKEMGLSDKVKALPKGEGGKSLPNFLESFKDDKYTNVGNLKEVNFDKIAATKPEVIFISGRTANQKNLDEFKKAAPKAKIVYVGADEKNLIGSMKQNTENIGKIYDKEDKAKELNKDLDNKIASMKDKTKNFNKTVMYLLVNEGELSTFGPKGRFGGLVYDTLGFNAVDKKVSNSNHGQNVSNEYVNKENPDVILAMDRGQAISGKSTAKQALNNPVLKNVKAIKEDKVYNLDPKLWYFAAGSTTTTIKQIEELDKVVK

SEQ ID NO: 545 - protein, 342 aa, Staphylococcus aureus
MKKTVLYLVVAVMFLLAACGNNSDKEQSKSETKGSKDTVKIENNYKMRGEKKDGSDAKKVKETVEVPKNPKNAVVLDYGALDVMKEMGLSDKVKALPKGEGGKSLPNFLESFKDDKYTNVGNLKEVNFDKIAATKPEVIFISGRTANQKNLDEFKKAAPKAKIVYVGADEKNLISSMKQNTENIGKIYDKEDKAKELNKDLDNKIASMKDKTKKFNKSVMYLLVNEGELSTFGPKGRFGGLVYDTLGFNAVDKNVSNSNHGQNVSNEYINKENPDVILAMDRGQAVSGKSTAKQALNNPVLKNVKAIKEDKVYNLDPKLWYFAAGSTTTTIKQIDELEKVVK

SEQ ID NO: 546 - protein, 342 aa, Staphylococcus aureus; identical to SEQ ID NO: 544

SEQ ID NO: 547 - protein, 342 aa, Staphylococcus aureus; identical to SEQ ID NO: 544

SEQ ID NO: 548 - protein, 342 aa, Staphylococcus aureus; identical to SEQ ID NO: 544

SEQ ID NO: 549 - protein, 342 aa, Staphylococcus aureus; identical to SEQ ID NO: 544

SEQ ID NO: 550 - protein, 342 aa, Staphylococcus aureus; identical to SEQ ID NO: 544

SEQ ID NO: 551 - protein, 342 aa, Staphylococcus aureus; identical to SEQ ID NO: 544

SEQ ID NO: 552 - protein, 342 aa, Staphylococcus aureus; identical to SEQ ID NO: 544

SEQ ID NO: 553 - protein, 302 aa, Staphylococcus aureus; identical to SEQ ID NO: 387

SEQ ID NO: 554 - protein, 302 aa, Staphylococcus aureus; identical to SEQ ID NO: 387

SEQ ID NO: 555 - protein, 302 aa, Staphylococcus aureus; identical to SEQ ID NO: 389

SEQ ID NO: 556 - protein, 302 aa, Staphylococcus aureus; identical to SEQ ID NO: 387

SEQ ID NO: 557 - protein, 302 aa, Staphylococcus aureus; identical to SEQ ID NO: 387

SEQ ID NO: 558 - protein, 302 aa, Staphylococcus aureus; identical to SEQ ID NO: 387

SEQ ID NO: 559 - protein, 302 aa, Staphylococcus aureus; identical to SEQ ID NO: 387

SEQ ID NO: 560 - protein, 302 aa, Staphylococcus aureus; identical to SEQ ID NO: 387

SEQ ID NO: 561 - protein, 302 aa, Staphylococcus aureus; identical to SEQ ID NO: 387

SEQ ID NO: 562 - protein, 302 aa, Staphylococcus aureus; identical to SEQ ID NO: 387

SEQ ID NO: 563 - DNA, 1002 bp, Staphylococcus aureus
atgaagaaaacagtcttatatttagtattagcagtaatgtttttattagcggcatgcggtaacaattctgataaagaacaatcaaaatcagaaactaaaggttcaaaagaaacggttaaaattgaaaataactataaaatgcgtggcgagaaaaaagatggtagtgacgctaaaaaagttaaagaaactgttgaagtaccaaagaatcctaaaaatgcagttgtgttagactatggcgcattagatgtaatgaaagaaatgggcttatcagacaaagtaaaagcattaccgaatttcttagaatcatttaaagatgataaatatacaaacattggtaatttaaaagaagtgaattttgataaaattgctgcgacgaaacccgaagtaatctttatctctggacgtacagctaatcaaaagaatttagatgaattcaaaaaagctgcacctaaagcgaaaattgtttatgttggtgcagatgaaaagaacttaattggttcaatgaaacaaaacactgaaaatatcggtaaaatctacgacaaagaagtcaaagctaaagagttaaataaagatttagataataaaattgcttcaatgaaagataaaacgaaaaacttcaataaaactgttatgtatttactagttaacgaaggtgaattatcaacatttggacctaaaggtcgttttggtggattagtttacgatacattaggattcaatgcagttgataaaaaagtaagtaatagtaatcatggacaaaatgtttctaacgaatatgtaaataaagaaaatccagatgttattttagcgatggatagaggtcaagcggtaagtggtaaatcaactgcgaaacaagcattaaataatcctgtattaaaaaatgttaaagcaattaaagaagacaaagtttataatttagatcctaaattatggtactttgcagctggatcaactacaactacaattaaacaaattgaggaacttgataaagttgtaaaataa

SEQ ID NO: 564 - DNA, 1029 bp, Staphylococcus aureus
atgaagaaaacagtcttatatttagtattagcagtaatgtttttattagcggcatgcggtaacaattctgataaagaacaatcaaaatcagaaactaaaggttctaaagatacagtaaaaattgaaaataactataaaatgcgtggcgagaaaaaagatggtagtgacgctaaaaaagttaaagaaactgttgaagtaccaaaaaatcctaaaaatgcagttgtgttagactatggcgcattagatgtaatgaaagaaatgggcttatcagataaagtaaaagcattacctaaaggggaaggcggtaagtcattaccgaatttcttagaatcatttaaagatgataaatatacaaacgttggtaatttaaaagaagtgaattttgataaaattgctgcgacgaaacccgaagtaatctttatctctggacgtacagctaatcaaaagaatttagatgaattcaaaaaagctgcacctaaagcgaaaattgtttatgttggtgcagatgaaaagaacttaattggttcaatgaaacaaaacactgaaaatatcggtaaaatttacgataaagaagataaagctaaagaattaaataaagatttagataacaaaattgcttcaatgaaagataaaacgaaaaacttcaataaaactgttatgtatttactagttaacgaaggtgaattatcaacatttggacctaaaggtcgttttggtggattagtttacgatacattaggattcaatgcagttgataaaaaagtaagtaatagcaatcatggacaaaatgtttctaacgaatatgttaataaagaaaatccagatgttattttagcgatggatagaggtcaagcgataagtggtaaatcaactgcgaaacaagcattaaataatcctgtattaaaaaatgttaaagcaattaaagaagacaaagtatataatttagatcctaaattatggtactttgcagctggatcaactacaactacaattaaacaaattgaggaacttgataaagttgtaaaataa

SEQ ID NO: 565 - DNA, 1029 bp, Staphylococcus aureus
atgaagaaaacagtcttatatttagtagtagcagtaatgtttttattagcggcatgcggtaacaattctgataaagaacaatcaaaatcagaaactaaaggttctaaagatacagtaaaaattgaaaacaactataaaatgcgtggcgagaaaaaagatggtagcgatgctaaaaaagttaaagaaactgttgaagtaccaaagaaccctaaaaatgcagttgtattagattatggcgcattagatgtaatgaaagaaatgggcttatcagacaaagtaaaagcattacctaaaggtgaaggcggcaagtcattaccgaatttcttagagtcatttaaagatgacaagtatacaaatgttggtaacttgaaagaagttaatttcgataaaattgcagcaacaaaaccggaagtaatctttatctctggccgtacagcaaatcaaaagaatttagatgaatttaaaaaagctgcaccaaaagcaaaaattgtttacgttggtgcagatgaaaagaatttaattagttcaatgaaacaaaacactgaaaatattggtaaaatttacgataaagaagataaagctaaagaattaaataaagatttagataacaaaattgcttcaatgaaagataaaactaagaagttcaacaaatcagttatgtatttattagttaatgaaggtgaattatcaacatttggacctaaaggtcgtttcggtggattagtttacgatacattaggtttcaacgcggttgataaaaacgtaagcaatagtaaccacggacaaaatgtctctaacgaatacattaataaagaaaatccagatgttattttagcaatggatagaggacaggctgtaagtggtaaatcaactgcgaaacaagcattaaataatcctgtattaaaaaatgttaaagcaattaaagaagacaaagtttataatttagaccctaaattatggtactttgcagctggatcaactacaactacaattaaacaaattgatgaacttgaaaaagttgtaaaataa

SEQ ID NO: 566 - DNA, 1029 bp, Staphylococcus aureus; identical to SEQ ID NO: 564

SEQ ID NO: 567 - DNA, 1029 bp, Staphylococcus aureus
atgaagaaaacagtcttatatttagtattagcagtaatgtttttattagcggcatgcggtaacaattctgataaagaacaatcaaaatcagaaactaaaggttctaaagatacagtaaaaattgaaaataactataaaatgcgtggcgagaaaaaagatggtagtgacgctaaaaaagttaaagaaactgttgaagtaccaaaaaatcctaaaaatgcagttgtgttagactatggcgcattagatgtaatgaaagaaatgggcttatcagataaagtaaaagcattacctaaaggggaaggcggtaagtcattaccgaatttcttagaatcatttaaagatgataaatatacaaacgttggtaatttaaaagaagtgaattttgataaaattgctgcgacgaaacccgaagtaatctttatctctggacgtacagctaatcaaaagaatttagatgaattcaaaaaagctgcacctaaagcgaaaattgtttatgttggtgcagatgaaaagaacttaattggttcaatgaaacaaaacactgaaaatatcggaaaaatttacgataaagaagataaagctaaagaattaaataaagatttagataacaaaattgcttcaatgaaagataaaacgaaaaacttcaataaaactgttatgtatttactagttaacgaaggtgaattatcaacatttggacctaaaggtcgttttggtggattagtttacgatacattaggattcaatgcagttgataaaaaagtaagtaatagcaatcatggacaaaatgtttctaacgaatatgttaataaagaaaatccagatgttattttagcgatggatagaggtcaagcgataagtggtaaatcaactgcgaaacaagcattaaataatcctgtattaaaaaatgttaaagcaattaaagaagacaaagtatataatttagatcctaaattatggtactttgcagctggatcaactacaactacaattaaacaaattgaggaacttgataaagttgtaaaataa

SEQ ID NO: 568 - DNA, 1029 bp, Staphylococcus aureus; identical to SEQ ID NO: 564

SEQ ID NO: 569 - DNA, 1029 bp, Staphylococcus aureus; identical to SEQ ID NO: 567

SEQ ID NO: 570 - DNA, 1029 bp, Staphylococcus aureus; identical to SEQ ID NO: 567

SEQ ID NO: 571 - DNA, 1029 bp, Staphylococcus aureus; identical to SEQ ID NO: 567

SEQ ID NO: 572 - DNA, 1029 bp, Staphylococcus aureus; identical to SEQ ID NO: 564

SEQ ID NO: 573 - DNA, 909 bp, Staphylococcus aureus
atgaaaaaactattattaccattaataattatgttattagtgttagctgcgtgtgggaaccaaggtgaaaaaaataacaaagctgaaactaaatcttataaaatggacgatggcaaaacggtagatattccgaaagaccctaaacgcattgcagtagttgcgccaacatatgctggtggacttaaaaaattaggtgcaaacattgtagctgtaaatcaacaagtcgatcaaagcaaagtattaaaagataaatttaaaggtgttacaaaaattggtgatggcgatgtagaaaaggttgctaaagaaaagccagatttaattattgtatactctactgacaaagacattaaaaaatatcaaaaagtagcaccaacagtagttgttgactataataagcataaatatttagaacaacaagaaatgttagggaaaattgttggtaaagaagataaagtaaaagcttggaagaaagattgggaagaaacaactgctaaagacggtaaagaaattaaaaaagcaattggacaagatgcaacagtgtcgttgtttgatgaatttgataaaaaattatacacttacggcgataactggggtcgtggtggagaagtactatatcaagcatttggtttaaaaatgcaaccagaacaacaaaagttaactgcaaaagcaggttgggctgaagtgaaacaagaagaaattgaaaaatatgctggtgattacattgtgagtacaagtgaaggtaaacctacaccaggatatgaatcaacaaacatgtggaagaatttgaaagctactaaagaaggacatattgttaaagttgatgctggtacatactggtacaacgatccttatacattagatttcatgcgtaaagatttaaaagaaaaattaattaaagctgcaaaataa

SEQ ID NO: 574 - DNA, 909 bp, Staphylococcus aureus
atgaaaaaactattattaccattaataattatgttattagtgttagctgcgtgtgggaaccaaggtgaaaaaaataacaaagctgaaactaaatcttataaaatggacgatggcaaaacggtagatattccgaaagaccctaaacgcattgcagtagttgcgccaacatatgctggtggacttaaaaaattaggtgcaaacattgtagctgtaaatcaacaagtcgatcaaagcaaagtattaaaagataaatttaaaggtgttacaaaaattggtgatggcgatgtagaaaaagttgctaaagaaaagccagatttaattattgtatactctactgacaaagatattaaaaaatatcaaaaagtagcaccaacagtagttgttgactataataagcataaatatttagaacaacaagaaatgttagggaaaattgttggtaaagaagataaagtaaaagcttggaagaaagattgggaagaaacaactgctaaagacggtaaagaaattaaaaaagcaattggacaagatgcaacagtgtcattgtttgatgaatttgataaaaaattatacacttacggcgataactggggtcgtggtggagaagtattatatcaagcatttggtttgaaaatgcaaccagaacaacaaaagttaactgcaaaagcaggttgggctgaagtgaaacaagaagaaattgaaaaatatgctggtgattacattgtgagtacaagtgaaggtaaacctacaccaggatatgaatcaacaaacatgtggaagaatttgaaagctactaaagaaggacatattgttaaagttgatgctggtacatactggtacaacgatccttatacattagatttcatgcgtaaagatttaaaagaaaaattaattaaagctgcaaaataa

SEQ ID NO: 575 - DNA, 909 bp, Staphylococcus aureus
atgaaaaaactattattaccattaataattatgttattagtgttagctgcgtgtgggaaccaaggtgaaaaaaataacaaagctgaaactaaatcttataaaatggacgatggcaaaacggtagatattccgaaagaccctaaacgcattgcagtagttgcgccaacatatgctggtggacttaaaaaattaggtgcaaacattgtagctgtaaatcaacaagttgatcaaagcaaagtgttaaaagataaatttaaaggtgttactaaaattggtgatggtgatatagaaaaagttgctaaagaaaagccagatttaattattgtatactctactgacaaagacattaaaaagtatcaaaaagtagcaccaacagtagttgttgactataataagcataaatacttagaacaacaagaaatgttagggaaaattgttggtaaagaagataaagtaaaagcttggaagaaagattgggaagaaacaactgctaaagacggtaaagaaattaaaaaagcaattggacaagatgcaacagtgtcattgtttgatgaatttgataaaaaattatacacttacggcgataactggggtcgtggtggagaagtattatatcaagcatttggtttaaaaatgcaaccagaacaacaaaagttaactgcaaaagcaggttgggctgaagtgaaacaagaagaaattgaaaaatatgctggtgattacattgtgagtacaagtgaaggtaaacctacaccaggatacgaatcaacaaacatgtggaagaatttgaaagctactaaagaaggacatattgttaaagttgatgctggtacatactggtacaacgatccttatacattagatttcatgcgtaaagatttaaaagaaaaattaattaaagctgcaaaataa

SEQ ID NO: 576 - DNA, 909 bp, Staphylococcus aureus
atgaaaaaactattattaccattaataattatgttattagtgttagctgcgtgtgggaaccaaggtgaaaaaaataacaaagctgaaactaaatcttataaaatggacgatggcaaaacggtagatattccgaaagaccctaaacgcattgcagtagttgcgccaacatatgctggtggacttaaaaaattaggtgcaaacattgtagctgtaaatcaacaagtcgatcaaagcaaagtattaaaagataaatttaaaggtgttacaaaaattggtgatggcgatgtagaaaaagttgctaaagaaaagccagatttaattattgtatactctactgacaaagatattaaaaaatatcaaaaagtagcaccaacagtagttgttgactataataagcataaatatttagaacaacaagaaatgttagggaaaattgttggtaaagaagataaagtaaaagcttggaagaaagattgggaagaaacaactgctaaagacggtaaagaaattaaaaaagcaattggacaagatgcaacagtgtcattgtttgatgaatttgataaaaaattatacacttacggcgataactggggtcgtggtggagaagtattatatcaagcatttggtttaaaaatgcaaccagaacaacaaaagttaactgcaaaagcaggttgggctgaagtgaaacaagaagaaattgaaaaatatgctggtgattacattgtgagtacaagtgaaggtaaacctacaccaggatatgaatcaacaaacatgtggaagaatttgaaagctactaaagaaggacatattgttaaagttgatgctggtacatactggtacaacgatccttatacattagatttcatgcgtaaagatttaaaagaaaaattaattaaagctgcaaaataa

SEQ ID NO: 577 - DNA, 909 bp, Staphylococcus aureus
atgaaaaaactattattaccattaataattatgttattagtgttagctgcgtgtgggaaccaaggtgaaaaaaataacaaagctgaaactaaatcttataaaatggacgatggcaaaacggtagatattccgaaagaccctaaacgcattgcagtagttgcgccaacatatgctggtggacttaaaaaattaggtgcaaacattgtagctgtaaatcaacaagtcgatcaaagcaaagtattaaaagataaatttaaaggtgttacaaaaattggtgatggcgatgtagaaaaagttgctaaagaaaagccagatttaattattgtatactctactgacaaagatattaaaaaatatcaaaaagtagcaccaacagtagttgttgactataataagcataaatatttagaacaacaagaaatgttagggaaaattgttggtaaagaagataaagtaaaagcttggaagaaagattgggaagaaacaactgctaaagacggtaaagaaattaaaaaagcaattggacaagatgcaacagtgtcattgtttgatgaatttgataaaaaattatacacttacggcgataactggggtcgtggtggagaagtattatatcaagcatttggtttgaaaatgcaaccagaacaacaaaagttaactgcaaaagcaggttgggctgaagtgaaacaagaagaaattgaaaaatatgctggtgattacattgtgagtacaagtgaaggtaaacctacaccaggatacgaatcaacaaacatgtggaagaatttgaaagctactaaagaaggacatattgttaaagttgatgctggtacatactggtacaacgatccttatacattagatttcatgcgtaaagatttaaaagaaaaattaattaaagctgcaaaataa

SEQ ID NO: 578 - DNA, 909 bp, Staphylococcus aureus
atgaaaaaactattattaccattaataattatgttattagtgttagctgcgtgtgggaaccaaggtgaaaaaaataacaaagctgaaactaaatcttataaaatggacgatggcaaaacggtagatattccgaaagaccctaaacgcattgcagtagttgcgccaacatatgctggtggacttaaaaaattaggtgcaaacattgtagctgtaaatcaacaagtcgatcaaagcaaagtattaaaagataaatttaaaggtgttacaaaaattggtgatggcgatgtagaaaaagttgctaaagaaaagccagatttaattattgtatactctactgacaaagatattaaaaaatatcaaaaagtagcaccaacagtagttgttgactataataagcataaatatttagaacaacaagaaatgttagggaaaattgttggtaaagaagataaagtaaaagcctggaagaaagattgggaagaaacaactgctaaagacggtaaagaaattaaaaaagcaattggacaagatgcaacagtgtcattgtttgatgaatttgataaaaaattatacacttacggcgataactggggtcgtggtggagaagtattatatcaagcatttggtttgaaaatgcaaccagaacaacaaaagttaactgcaaaagcaggttgggctgaagtgaaacaagaagaaattgaaaaatatgctggtgattacattgtgagtacaagtgaaggtaaacctacaccaggatatgaatcaacaaacatgtggaagaatttgaaagctactaaagaaggacatattgttaaagttgatgctggtacatactggtacaacgatccttatacattagatttcatgcgtaaagatttaaaagaaaaattaattaaagctgcaaaataa

SEQ ID NO: 579 - DNA, 909 bp, Staphylococcus aureus; identical to SEQ ID NO: 577

SEQ ID NO: 580 - DNA, 909 bp, Staphylococcus aureus; identical to SEQ ID NO: 577

SEQ ID NO: 581 - DNA, 909 bp, Staphylococcus aureus; identical to SEQ ID NO: 577

SEQ ID NO: 582 - DNA, 909 bp, Staphylococcus aureus; identical to SEQ ID NO: 576

SEQ ID NO: 583 - protein, 6 aa, artificial
  polypeptide fragment included in mass fingerprint
IIGDYR

SEQ ID NO: 584 - protein, 6 aa, artificial
  polypeptide fragment included in mass fingerprint
IFTDYR

SEQ ID NO: 585 - protein, 9 aa, artificial
  polypeptide fragment included in mass fingerprint
EQQLDVISR

SEQ ID NO: 586 - protein, 10 aa, artificial
  polypeptide fragment included in mass fingerprint
LREELSEQYR

SEQ ID NO: 587 - protein, 20 aa, artificial
  polypeptide fragment included in mass fingerprint
TMATGIAGLSVAADSLSAIK

SEQ ID NO: 588 - protein, 19 aa, artificial
  polypeptide fragment included in mass fingerprint
AGVITESEVQEIIDHFIMK

SEQ ID NO: 589 - protein, 23 aa, artificial
  polypeptide fragment included in mass fingerprint
FLHSLDNLGPAPEPNLTVLWSVR

SEQ ID NO: 590 - protein, 24 aa, artificial
  polypeptide fragment included in mass fingerprint
SGAQVGPNFEGINSEVLEYDEVFK

SEQ ID NO: 591 - protein, 25 aa, artificial
  polypeptide fragment included in mass fingerprint
SGAQVGPNFEGINSEVLEYDEVFKK

SEQ ID NO: 592 - protein, 30 aa, artificial; identical to SEQ ID NO: 225
  polypeptide fragment included in mass fingerprint

SEQ ID NO: 593 - protein, 6 aa, artificial
  polypeptide fragment included in mass fingerprint
IFTDYR

SEQ ID NO: 594 - protein, 15 aa, artificial
  polypeptide fragment included in mass fingerprint
DLETIVGVQTEKPFK

SEQ ID NO: 595 - protein, 16 aa, artificial
  polypeptide fragment included in mass fingerprint
DLETIVGVQTEKPFKR

SEQ ID NO: 596 - protein, 20 aa, artificial
  polypeptide fragment included in mass fingerprint
TMATGIAGLSVAADSLSAIK

SEQ ID NO: 597 - protein, 17 aa, artificial
  polypeptide fragment included in mass fingerprint
NEEGLVVDFEIEGDFPK

SEQ ID NO: 598 - protein, 23 aa, artificial
  polypeptide fragment included in mass fingerprint
FLHSLDNLGPAPEPNLTVLWSVR

SEQ ID NO: 599 - protein, 24 aa, artificial
  polypeptide fragment included in mass fingerprint
SGAQVGPNFEGINSEVLEYDEVFK

SEQ ID NO: 600 - protein, 26 aa, artificial
  polypeptide fragment included in mass fingerprint
EFIQLNYTLYEGNDSFLAGPTEATSK

SEQ ID NO: 601 - protein, 6 aa, artificial
  polypeptide fragment included in mass fingerprint
IVKFAR

SEQ ID NO: 602 - protein, 10 aa, artificial
  polypeptide fragment included in mass fingerprint
TLLYAINGGK

SEQ ID NO: 603 - protein, 9 aa, artificial
  polypeptide fragment included in mass fingerprint
EQQLDVISR

SEQ ID NO: 604 - protein, 11 aa, artificial
  polypeptide fragment included in mass fingerprint
VDDIAVDLVER

SEQ ID NO: 605 - protein, 11 aa, artificial
  polypeptide fragment included in mass fingerprint
LPDNFKTYCAK

SEQ ID NO: 606 - protein, 14 aa, artificial
  polypeptide fragment included in mass fingerprint
DQKGALSSLSSVAK

SEQ ID NO: 607 - protein, 15 aa, artificial
  polypeptide fragment included in mass fingerprint
VASTITSHDAGYLDK

SEQ ID NO: 608 - protein, 15 aa, artificial
  polypeptide fragment included in mass fingerprint
DLETIVGVQTEKPFK

SEQ ID NO: 609 - protein, 17 aa, artificial
  polypeptide fragment included in mass fingerprint
MSIKTSSIQYENDDIMR

SEQ ID NO: 610 - protein, 23 aa, artificial
  polypeptide fragment included in mass fingerprint
FLHSLDNLGPAPEPNLTVLWSVR

SEQ ID NO: 611 - protein, 24 aa, artificial
  polypeptide fragment included in mass fingerprint
SGAQVGPNFEGINSEVLEYDEVFK

SEQ ID NO: 612 - protein, 7 aa, artificial
  polypeptide fragment included in mass fingerprint
TFYPEAR

SEQ ID NO: 613 - protein, 8 aa, artificial
  polypeptide fragment included in mass fingerprint
QFWGHLVK

SEQ ID NO: 614 - protein, 9 aa, artificial
  polypeptide fragment included in mass fingerprint
WIPLMMKGR

SEQ ID NO: 615 - protein, 10 aa, artificial
  polypeptide fragment included in mass fingerprint
VINEEFEISK

SEQ ID NO: 616 - protein, 10 aa, artificial
  polypeptide fragment included in mass fingerprint
YSFDQVIMTK

SEQ ID NO: 617 - protein, 11 aa, artificial
  polypeptide fragment included in mass fingerprint
NEDWQLYTAGK

SEQ ID NO: 618 - protein, 13 aa, artificial
  polypeptide fragment included in mass fingerprint
TLLFGPFANVGPK

SEQ ID NO: 619 - protein, 13 aa, artificial
  polypeptide fragment included in mass fingerprint
GREDNPGIMAASK

SEQ ID NO: 620 - protein, 12 aa, artificial
  polypeptide fragment included in mass fingerprint
LDRPAIESSNER

SEQ ID NO: 621 - protein, 12 aa, artificial
  polypeptide fragment included in mass fingerprint
NEDWQLYTAGKR

SEQ ID NO: 622 - protein, 14 aa, artificial
  polypeptide fragment included in mass fingerprint
IDEGTDVNFGELTR

SEQ ID NO: 623 - protein, 13 aa, artificial
  polypeptide fragment included in mass fingerprint
EFINPLPHISYVR

SEQ ID NO: 624 - protein, 13 aa, artificial
  polypeptide fragment included in mass fingerprint
EIEPDWNIHVYER

SEQ ID NO: 625 - protein, 16 aa, artificial
  polypeptide fragment included in mass fingerprint
EPPGTPPMTVPHLDTR

SEQ ID NO: 626 - protein, 20 aa, artificial
  polypeptide fragment included in mass fingerprint
QVTDYVFIGAGGGAIPLLQK

SEQ ID NO: 627 - protein, 20 aa, artificial
  polypeptide fragment included in mass fingerprint
VYGKEPPGTPPMTVPHLDTR

SEQ ID NO: 628 - protein, 26 aa, artificial
  polypeptide fragment included in mass fingerprint
HLGGFPISGQFLACTNPQVIEQHDAK

SEQ ID NO: 629 - protein, 9 aa, artificial
  polypeptide fragment included in mass fingerprint
AAAIDLAGR

SEQ ID NO: 630 - protein, 10 aa, artificial
  polypeptide fragment included in mass fingerprint
VVDANIAAQR

SEQ ID NO: 631 - protein, 9 aa, artificial
  polypeptide fragment included in mass fingerprint
ADIDLPFER

SEQ ID NO: 632 - protein, 13 aa, artificial
  polypeptide fragment included in mass fingerprint
LVGGAGEETIIAR

SEQ ID NO: 633 - protein, 14 aa, artificial
  polypeptide fragment included in mass fingerprint
HHTEVLENPDNISK

SEQ ID NO: 634 - protein, 17 aa, artificial
  polypeptide fragment included in mass fingerprint
VVEAESEVPLAMAEALR

SEQ ID NO: 635 - protein, 22 aa, artificial
  polypeptide fragment included in mass fingerprint
AAAIDLAGRDVLEAVQMSVNPK

SEQ ID NO: 636 - protein, 22 aa, artificial
  polypeptide fragment included in mass fingerprint
AGLALTTNQLESHYLAGGNVDR

SEQ ID NO: 637 - protein, 27 aa, artificial
  polypeptide fragment included in mass fingerprint
TVLSKGLDSGTAFEILSIDIADVDISK

SEQ ID NO: 638 - protein, 6 aa, artificial
  polypeptide fragment included in mass fingerprint
FVFHGR

SEQ ID NO: 639 - protein, 8 aa, artificial
  polypeptide fragment included in mass fingerprint
DGFNNIER

SEQ ID NO: 640 - protein, 13 aa, artificial
  polypeptide fragment included in mass fingerprint
GHVYNGISGGQFK

SEQ ID NO: 641 - protein, 12 aa, artificial
  polypeptide fragment included in mass fingerprint
YTPTSILYFNPK

SEQ ID NO: 642 - protein, 13 aa, artificial
  polypeptide fragment included in mass fingerprint
QLAEDLQKHLGAK

SEQ ID NO: 643 - protein, 15 aa, artificial
  polypeptide fragment included in mass fingerprint
NHSEYVTDMRLIGIR

SEQ ID NO: 644 - protein, 16 aa, artificial
  polypeptide fragment included in mass fingerprint
DLPPMEQVFDTLDLDK

SEQ ID NO: 645 - protein, 16 aa, artificial
  polypeptide fragment included in mass fingerprint
IRPEDMHIMANIFLPK

SEQ ID NO: 646 - protein, 17 aa, artificial
  polypeptide fragment included in mass fingerprint
RIRPEDMHIMANIFLPK

SEQ ID NO: 647 - protein, 20 aa, artificial
  polypeptide fragment included in mass fingerprint
ISHLVLTRTGLYIIDSQLLK

What is claimed is:

1. A composition comprising:
   an isolated polypeptide comprising the amino acid sequence of SEQ ID NO:397, with the proviso that if the isolated polypeptide includes additional amino acids at the amino terminal, the additional amino acids include at least two amino acid modifications compared to amino acids 1-26 of SEQ ID NO:399, wherein the at least two amino acid modifications comprise:
      at least two amino acid substitutions;
      at least two amino acid deletions; or
      at least one amino acid substitution and at least one amino acid deletion; and
   an effective amount of a pharmaceutically acceptable adjuvant.

2. The composition of claim 1 further comprising a pharmaceutically acceptable carrier.

3. The composition of claim 1 further comprising at least one second polypeptide, wherein the second polypeptide is isolatable from a Staphylococcus aureus when incubated in culture media comprising an iron chelator and not isolatable when grown in the culture media without the iron chelator.

4. The composition of claim 3 wherein the second polypeptide comprises an amino acid sequence having at least 95% similarity to the amino acid sequence of any one of SEQ ID NO: 353, SEQ ID NO: 354, SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362, SEQ ID NO: 363, SEQ ID NO: 364, SEQ ID NO: 365, SEQ ID NO: 366, SEQ ID NO: 367, SEQ ID NO: 368, SEQ ID NO: 369, SEQ ID NO: 370, SEQ ID NO: 371, SEQ ID NO: 372, SEQ ID NO: 373, SEQ ID NO: 374, SEQ ID NO: 375, SEQ ID NO: 376, SEQ ID NO: 377, SEQ ID NO: 378, SEQ ID NO: 379, SEQ ID NO: 380, SEQ ID NO: 381, SEQ ID NO: 382, SEQ ID NO: 383, SEQ ID NO: 384, SEQ ID NO: 385, SEQ ID NO: 386, SEQ ID NO: 387, SEQ ID NO: 388, SEQ ID NO: 389, SEQ ID NO: 390, SEQ ID NO: 391, SEQ ID NO: 392, SEQ ID NO: 393, SEQ ID NO: 394, SEQ ID NO: 395, SEQ ID NO: 396, SEQ ID NO: 419, SEQ ID NO: 420, SEQ ID NO: 421, SEQ ID NO: 422, SEQ ID NO: 423, SEQ ID NO: 424, SEQ ID NO: 425, SEQ ID NO: 426, SEQ ID NO: 427, SEQ ID NO: 428, or SEQ ID NO: 429.

5. The composition of claim 1 further comprising at least one second polypeptide, wherein the second polypeptide is isolatable from a Staphylococcus aureus when incubated in culture media comprising an iron chelator, is not isolatable when grown in the culture media without the iron chelator, and comprises an amino acid sequence having at least 95% similarity to the amino acid sequence of any one of SEQ ID NO: 408, SEQ ID NO: 409, SEQ ID NO: 410, SEQ ID NO: 411, SEQ ID NO: 412, SEQ ID NO: 413, SEQ ID NO: 414, SEQ ID NO: 415, SEQ ID NO: 416, SEQ ID NO: 417, or SEQ ID NO: 418.

6. The composition of claim 5 wherein the second polypeptide comprises an amino acid sequence having at least 95% identity to the amino acid sequence of any one of SEQ ID NO: 408, SEQ ID NO: 409, SEQ ID NO: 410, SEQ ID NO: 411, SEQ ID NO: 412, SEQ ID NO: 413, SEQ ID NO: 414, SEQ ID NO: 415, SEQ ID NO: 416, SEQ ID NO: 417, or SEQ ID NO: 418.

7. The composition of claim 1 further comprising:
an isolated polypeptide that is isolatable from a *S. aureus* when grown in culture media without an iron chelator and has a molecular weight of 150 kDa, 132 kDa, 120 kDa, 75 kDa, 58 kDa, 50 kDa, 44 kDa, 43 kDa, 41 kDa, 40 kDa; or
a combination of said isolated polypeptides.

* * * * *